United States Patent 12,790,634 (MOST PROBABLE NUMBER ANALYSIS OF HETEROGENOUS POPULATIONS) - sequence listing, part 18

SEQ ID NO: 13 - DNA, 3519255 bp, Anaerotruncus colihominis (residues 1-1,759,628 of 3,519,255)
  source 1..3519255: mol_type = genomic DNA
ggcaggggcagcgcccctctggagcgaggcagcgcacgaccggcagcacacgcagccggtagacgcagccagctccagcaccccccgcggagcgcgcaaaagcactttcatactgccagcccataaagggcggcggtgtgaaagtgcttttgcgttactttctcaccagaaagtaacaaagaggttgccttatcggtagctgtatggtaaaatgggagcaggataaaacacggaaaaaacagcgcagaggaaaggaagggtgagaggtatcggtacaaccatttccggcatgatgggacatggcagcatccggcataacaaccgggagttcacggcagccaatgtagatcgtgaacggtcggggcagaatatcgtttttgtcaacgagaatctgaagcagacctatgacaacctgttcggtgaagcgctggaggcatacaacgccgggaagaaaaaaacaagggacaagatcccggactactacgagcatatccggcagagcaagcaggagaagctgttccatgaggccatcttccagatcggcaacctgaacgactgcggctacggtacagagggtggccagcgggcagcggaggcactgacagagttcgcaaagacctttcaggagcgcaatccccatctccatgtgttcaacatggtgctgcacatggacgaagccacgccacaccttcatgtagactatatcccggtggccacggagcagacgaggggactgtctacgagggtgtctatgaagcaggcgctcaagcagcagggctttacaggcgttggccggaaacagaccgagtggaaggcttggatggatcgggaaaaggaagtgctgacggagatcgctcagcagcacgaatttgaaattatttctctcggcagcaatcggcggcacatggagctgccggagtaccgggcagcgatccaggaggccgaggccgtgcaggagcagacagcggcagctttgcaggagctggcagatatgcaggagaagaaaacggagttgaagggagagattaagtcgctctccggcactgtggcggcgctgaaggccgcagaacgggtgcgggttgacttcaataccattcagccggaaaaaacgctcacaggggctgtcaagggcgttaccgtggagcagatccagcagctcaagaaagtagccatgaccggagccgctgcgaagcagacggtggtggagctgaagaaggaaaatactgcgttggaagaagaaaaagccgagctgagaaagaagatcccttccgtccatgagaagatggaggcagcgaagcagcggagccttcttgaaaaccaaaaccggcatctctggagtgaaaacgaggagctgaaggaggcgctggaggaagaacgcagcttttcagaccggctgctggagggcattgaccgggtgctggatatgctggagcgtcatctgccgaagcagcttcttcatctcgtcgataaggcgagggagctgctgccggatcaccagacttatagtcaggaaaaaccgcacgagagagggcattcctggggagatatgagcctgtaaaaatagcctgtccgaagggcttgcaaccggcactcggacaggctataataacaggtgaaaatagggaaaaacctattgataatatatgcctccctaagagcctatggctcaaaacaaaaagaaaatttttctctcagaaagggagaaagtcggaggggaaaagggggtgtgcggaggggtgtgggaatgtggtaaacctgaaaggttttccatcatttccatgccccggagcaagggggaaaaggggaggtgactttctctttaagccgccgtaggcggcgctctttggctccccttttcccccttcccgcccgcaggcgttccccgccgcagcggattttcttttttgcttcttttttcttttctggattggaggtgttttcgtggctatggatcagcagactgctttggagcggcagcaggcgctttatcgggagaagaatgcccatcttcggcaatatttagagccggtggagccgtatgagttctatcgggagatcttcccggagggatcgtttgagcgcaaagggcattttgaggattccaagggaaacggtatcgctctggtagtccctccgaagtcaaaagtggtgcaggagaacggcgttgcactggagattaagggcgatggtaaagccaaccgtcatgtgatcacggacgagctgagggaactggaggacatcaaaggtacggactttacaatcatgtctcctatctcatattttggccggcagcgccggggacagaatgccaggtttctctatgcgatggtctttgaccttgatggtgtagggatgccgcagctccgggacacgctgcatcagatgaacaaggacattattcccaaggccaccttcgtggtaaacagcggaaccggcctgcatctgtattatgtgctgaccgagccgatccctatgtacccgcagaatcagaaggttttgaaggaactgaaatacgctctcacccggcagatctggaacaggtttacctcgtccatcaaggagccgcagatgcagggcattttgcagggtttccgtgtggtcggaaccagctccaagctggggaaggactatcctgtggtagcctatcggtatggcggtgcggtggagctggagaagctgctggactatatcccagacagcaatggggaacagcagcgcatacaggcgctcatgcgaaagagccgcctgtcgctggccgaggccaaagagaagtacccggactggtatgagcgccgggtggtgaagaaggagcgccgggggcgctggacggtgaagcgggatctctatgactggtggctgcatcggatcgctgacgagatccgggtggggcatcggttctacggaattatgacgctggccatctacgccaagaagtgcggcatagacgaagcggagctgcgcagggatgctttcgctctgctcaagccctacgatgatatgagcgaagaggacatcaaccgtttcacgaaggacgatattgtatgtgctctggagatgttcaatgaggactatgtgacctttccgagagatgatattgccaagctatccggcatgacgatgccggtcaataagagaaactggttaaaacaaaatcagcatttgtatttagctcgaagaagaaaagaggacatgaaagcggtaggcatttcaatgaaatctgcggaaggtagaccaacggcagagaaaatagttcatgtgtggaggcagcagcacccggacggacgtaaggcggactgtcatcgggacactggtcttgatcccaagacgatccgaaaatggtgggacagcgagccgtctgcggtgtggcaggaggatggacacatggtggcacgggtgcgaccgtcacaggcgttgagtgatctgctggtggatgccttgaaaaagagtgaggattagggttgattttcgggcgtttattgccgcaggacggcgcttccagccctccgagggtaactataccaccccctctgaaacgaggctaaaaaacggtataaaatcatgtttttttgacctctatatgtccacggtacgccgtgggcagcgagagagaaaaatcacggaacaagaataaattcgttgacaatcgtgcaacactatgggtataatataagcgaaaggagtgatcgtatgaacttctatactgtacgagatttgagaaccacgcccaagagcatctgggaaaatctttccgcagatggagaggttatcatcaccaacaacggcagaccgacggcgattctctttgatattgcggacggcagctttgaggaaacggtgaaggcagtccggcaggcaaaggccatgatcgcctttaactctatgagggcaaaggcagcagccaacggctacatgagcgacgaagatattgaagctgagattgccgcagttcgccggggggaatgatcgcttatgctggtggtgatagacacaaacattttggtgtcggcgctctggtcgagaaacggggcgcccgccagagtagtcagtatggtgctgacaggagatattgttccctgctatgattaccgtatcctgtgcgagtatcgggaagtgctgcaacggccaaagttcggattttcaaagagcgagatcaattccctgctggactggtttgaagcctgtggccggtctgtactggcggagccgcttgaagatgtgtttgtcgatgaggcagacaagaagttttacgaagtggcgaagttctgcggagcggtgctggttactggcaatctgaaacacttcccggaagatcctttggtcatgagcgttgcggattttttggaaaaaagaagaagctgagtaggggcaaaaccgcatgaaaacgatccgagagatagccaacgagcttggcgttgacaagcaaaaggtctatcgtttcatcaaacaaaaccacatcaatgaagcacatcatgaagcacttcaacgaagcggtgtgaagtactatgatgaagcagctgaaacccttataaaacaaggcttttcggacgaaaccgcatcaagtgaagcacatcatgaagcacatcaaaaccgcatcaatgaagcggtttttgatgcggttattgagatgctacaaaaggaacttgagataaaaaatgagcagatcaaagagctgaacgagcgcctgtcagagtgcagcgcagctttgctggcggcacagcagacggcacaggctgcgcaggcactccatgccgggacaattcagcagcagcttacagatggagccgccgatctggagcaggagcagccacaggccgatgtggtgtccggcgaaaagaaaggttggtttatccgcttgttcggtaggtaggagcagtcagacaaatcgaaatttggcaaaggagtgtgattgtatgaaaaagaaattctttgtggtaattgcaattatagttgttttagtaatcctattaacccctgttcgtatgaacttaaaagacggcggaagtgtaaggtataaagcattagtgtatgaagttacaaaaatacaccaactttcaccagaagtagatggtgaaaaaccatatattgatgggttcgaaatcaaaatactcggaatgacagtttatagagaaacaaacgaatagacaaattccagtttgtcggtgcggtttggctttcgggttgccgtccggttgccctttgcaaagggcaaagaggaccggggagccgcccgcaggcggcaggggcagcgcccctctggagcgaggcagcgcacgaccggcagcacacgcagccggtagacgcagccagctccagcaccccccgcggagcgcgcaaaagcactttcatactgccagcccataaagggcggcggtgtgaaagtgcttttgcgttactttctcaccagaaagtaacaaagaggttgccttatcggtagctgtatggtaaaatgggagcaggataaaacacggaaaaaacagcgcagaggaaaggaagggtgagaggtatcggtacaaccatttccggcatgatgggacatggcagcatccggcataacaaccgggagttcacggcagccaatgtagatcgtgaacggtcggggcagaatatcgtttttgtcaacgagaatctgaagcagacctatgacaacctgttcggtgaagcgctggaggcatacaacgccgggaagaaaaaaacaagggacaagatcccggactactacgagcatatccggcagagcaagcaggagaagctgttccatgaggccatcttccagatcggcaacctgaacgactgcggctacggtacagagggtggccagcgggcagcggaggcactgacagagttcgcaaagacctttcaggagcgcaatccccatctccatgtgttcaacatggtgctgcacatggacgaagccacgccacaccttcatgtagactatatcccggtggccacggagcagacgaggggactgtctacgagggtgtctatgaagcaggcgctcaagcagcagggctttacaggcgttggccggaaacagaccgagtggaaggcttggatggatcgggaaaaggaagtgctgacggagatcgctcagcagcacgaatttgaaattatttctctcggcagcaatcggcggcacatggagctgccggagtaccgggcagcgatccaggaggccgaggccgtgcaggagcagacagcggcagctttgcaggagctggcagatatgcaggagaagaaaacggagttgaagggagagattaagtcgctctccggcactgtggcggcgctgaaggccgcagaacgggtgcgggttgacttcaataccattcagccggaaaaaacgctcacaggggctgtcaagggcgttaccgtggagcagatccagcagctcaagaaagtagccatgaccggagccgctgcgaagcagacggtggtggagctgaagaaggaaaatactgcgttggaagaagaaaaagccgagctgagaaagaagatcccttccgtccatgagaagatggaggcagcgaagcagcggagccttcttgaaaaccaaaaccggcatctctggagtgaaaacgaggagctgaaggaggcgctggaggaagaacgcagcttttcagaccggctgctggagggcattgaccgggtgctggatatgctggagcgtcatctgccgaagcagcttcttcatctcgtcgataaggcgagggagctgctgccggatcaccagacttatagtcaggaaaaaccgcacgagagagggcattcctggggagatatgagcctgtaaaaatagcctgtccgaagggcttgcaaccggcactcggacaggctataataacaggtgaaaatagggaaaaacctattgataatatatgcctccctaagagcctatggctcaaaacaaaaagaaaatttttctctcagaaagggagaaagtcggaggggaaaagggggtgtgcggaggggtgtgggaatgtggtaaacctgaaaggttttccatcatttccatgccccggagcaagggggaaaaggggaggtgactttctctttaagccgccgtaggcggcgctctttggctccccttttcccccttcccgcccgcaggcgttccccgccgcagcggattttcttttttgcttcttttttcttttctggattggaggtgttttcgtggctatggatcagcagactgctttggagcggcagcaggcgctttatcgggagaagaatgcccatcttcggcaatatttagagccggtggagccgtatgagttctatcgggagatcttcccggagggatcgtttgagcgcaaagggcattttgaggattccaagggaaacggtatcgctctggtagtccctccgaagtcaaaagtggtgcaggagaacggcgttgcactggagattaagggcgatggtaaagccaaccgtcatgtgatcacggacgagctgagggaactggaggacatcaaaggtacggactttacaatcatgtctcctatctcatattttggccggcagcgccggggacagaatgccaggtttctctatgcgatggtctttgaccttgatggtgtagggatgccgcagctccgggacacgctgcatcagatgaacaaggacattattcccaaggccaccttcgtggtaaacagcggaaccggcctgcatctgtattatgtgctgaccgagccgatccctatgtacccgcagaatcagaaggttttgaaggaactgaaatacgctctcacccggcagatctggaacaggtttacctcgtccatcaaggagccgcagatgcagggcattttgcagggtttccgtgtggtcggaaccagctccaagctggggaaggactatcctgtggtagcctatcggtatggcggtgcggtggagctggagaagctgctggactatatcccagacagcaatggggaacagcagcgcatacaggcgctcatgcgaaagagccgcctgtcgctggccgaggccaaagagaagtacccggactggtatgagcgccgggtggtgaagaaggagcgccgggggcgctggacggtgaagcgggatctctatgactggtggctgcatcggatcgctgacgagatccgggtggggcatcggttctacggaattatgacgctggccatctacgccaagaagtgcggcatagacgaagcggagctgcgcagggatgctttcgctctgctcaagccctacgatgatatgagcgaagaggacatcaaccgtttcacgaaggacgatattgtatgtgctctggagatgttcaatgaggactatgtgacctttccgagagatgatattgccaagctatccggcatgacgatgccggtcaataagagaaactggttaaaacaaaatcagcatttgtatttagctcgaagaagaaaagaggacatgaaagcggtaggcatttcaatgaaatctgcggaaggtagaccaacggcagagaaaatagttcatgtgtggaggcagcagcacccggacggacgtaaggcggactgtcatcgggacactggtcttgatcccaagacgatccgaaaatggtgggacagcgagccgtctgcggtgtggcaggaggatggacacatggtggcacgggtgcgaccgtcacaggcgttgagtgatctgctggtggatgccttgaaaaagagtgaggattagggttgattttcgggcgtttattgccgcaggacggcgcttccagccctccgagggtaactataccaccccctctgaaacgaggctaaaaaacggtataaaatcatgtttttttgacctctatatgtccacggtacgccgtgggcagcgagagagaaaaatcacggaacaagaataaattcgttgacaatcgtgcaacactatgggtataatataagcgaaaggagtgatcgtatgaacttctatactgtacgagatttgagaaccacgcccaagagcatctgggaaaatctttccgcagatggagaggttatcatcaccaacaacggcagaccgacggcgattctctttgatattgcggacggcagctttgaggaaacggtgaaggcagtccggcaggcaaaggccatgatcgcctttaactctatgagggcaaaggcagcagccaacggctacatgagcgacgaagatattgaagctgagattgccgcagttcgccggggggaatgatcgcttatgctggtggtgatagacacaaacattttggtgtcggcgctctggtcgagaaacggggcgcccgccagagtagtcagtatggtgctgacaggagatattgttccctgctatgattaccgtatcctgtgcgagtatcgggaagtgctgcaacggccaaagttcggattttcaaagagcgagatcaattccctgctggactggtttgaagcctgtggccggtctgtactggcggagccgcttgaagatgtgtttgtcgatgaggcagacaagaagttttacgaagtggcgaagttctgcggagcggtgctggttactggcaatctgaaacacttcccggaagatcctttggtcatgagcgttgcggattttttggaaaaaagaagaagctgagtaggggcaaaaccgcatgaaaacgatccgagagatagccaacgagcttggcgttgacaagcaaaaggtctatcgtttcatcaaacaaaaccacatcaatgaagcacatcatgaagcacttcaacgaagcggtgtgaagtactatgatgaagcagctgaaacccttataaaacaaggcttttcggacgaaaccgcatcaagtgaagcacatcatgaagcacatcaaaaccgcatcaatgaagcggtttttgatgcggttattgagatgctacaaaaggaacttgagataaaaaatgagcagatcaaagagctgaacgagcgcctgtcagagtgcagcgcagctttgctggcggcacagcagacggcacaggctgcgcaggcactccatgccgggacaattcagcagcagcttacagatggagccgccgatctggagcaggagcagccacaggccgatgtggtgtccggcgaaaagaaaggttggtttatccgcttgttcggtaggtaggagcagtcagacaaatcgaaatttggcaaaggagtgtgattgtatgaaaaagaaattctttgtggtaattgcaattatagttgttttagtaatcctattaacccctgttcgtatgaacttaaaagacggcggaagtgtaaggtataaagcattagtgtatgaagttacaaaaatacaccaactttcaccagaagtagatggtgaaaaaccatatattgatgggttcgaaatcaaaatactcggaatgacagtttatagagaaacaaacgaatagacaaattccagtttgtcggtgcggtttggctttcgggttgccgtccggttgccctttgcaaagggcaaagaggaccggggagccgcccgcaggctggctccccaagttggactcgaaccaacgaccctgcggttaacagccgcatgctctaccggctgagctattgaggaatataaagaagatggatgccgcagtatggttatcatactgcggcaagtgctggcaaagacctatctttccaggcagtcacccgccaagtattgtcggcacaactgagcttaacttctgtgttcgggatgggaacaggtgggacctcagcgtaataaataccagctattgaaacgacatatttcaccgacggaagtttcctcccgtatcgcctgccgcaaggctctgtatatcatcctccgcccataggcggtcatgacctctggtgacccgtgcgggaatcgaacccgcgttaccggcgtgagaggccggtgtcttaaccgcttgaccaacgggccgtctcctgcgtcccctcaaaaggttccccttcctccggtccgctctttccaacctctcccggccggaacctctatcgtgagtgccccaaggcacagcatcttctggtgcgccatcagggactcgaacccgggacccgctgattaagagtcagctgctctaccaactgagctaatggcgcatgtctttccacgcaccctcaaaatcgaacaatgaaacttccctgctttcgaaaaccaaccttcgcctggtcaagccctcgaccgattagtaccgccttgctgcacgcctcacgacgcttccacatgcggcctatcaaccttgtagtcttcaaggggtcttacctgattactcagtggcatatcttatcttgaggtcggcttcacgcttagatgccttcagcgtttatccgatccgtacttagctgcccagctgtgccgttggcacgacaactggtgcaccagaggtacgtccatcccggtcctctcgtactagggacagctcctctcaaatatcctgcgcccacgacagatagggaccgaactgtctcacgacgttctgaacccagctcgcgtaccgctttaattggcgaacagccaaacccttgggaccgaattcagccccaggatgcgatgagccgacatcgaggtgccaaacctccccgacgatgtggactcttgggggagatcagcctgttatccccagggtagcttttatccgttgagcgatggcatttccactcacataccaccggatcactaactccaactttcgttactgctcgaactgtcgctctcgcagttaggctggcttgtgcgtttacactctctggcatggtttccgtccatgctgagccaacctttgagcgcctccgttacctttttggaggcgaccgccccagtcaaactgcccgcctaacactgtcccccgaccggattcacggccgcaggttagaatttcagcacctcaagagtggtatcccaacggcggctccagcaacactggcgtgctgccttctctgcctcccacctatcctgtacatgaaataccgaaatccaatattaagctgcagtaaagctccatggggtctttccgtcttgtcgcgggtaaccggcatcttcaccggtactacaatttcgccgggcgggctgttgagacagtgtccagatcgttacaccattcgtgcgggtcagaacttacctgacaaggaatttcgctaccttaggaccgttatagttacggccgccgtttaccggggcttcaattcagagctctcactcctcctcttaaccttccggcaccgggcaggtgtcaccccatatacgtcatctttcgatttagcatagagctgtgtttttgctaaacagtcgcctggacctattctctgcggctccctttcaggagcaccccttttccctaagttacggggtcaacttgccgagttccttaacaacccttctcccgttggccttagaattctcttcctgtctacctgtgtcggtttgcggtacgggtgcctcagatatccacagagcttttctcgcctgccgccaagtatgcttccctactatatttcagtccctttcgcccggggctaccaacgcccgggtcataccctttgacagtgtccctctgcttaaatcctccggcagctacggaatctctaccgtatgtgcatcggctacgccttccggcctcaccttagctcccggcttacccggagcggacgaaccttcctccggaaaccttagactttcggccaatatgattctcacatatttctcgctactcattccggcattctcactcgtatacagtccacatgcgctttcgctcatacttcaccccgtatacgacgctcccctaccattccttgcggaatcccaagcttcggttacacgtttagccccgttgaattttcggcgcagagtcactcgaccagtgagctattacgcactcttttaatgagtggctgcttctaagccaacatcctggttgtctgtgcaactccacatccttttccacttaacgtgtatttgggaccttagctgtgggtctgggctttttccctctcgaccacgagacttatctcacgtagtctgactgctgtacatcaattatccggcattcagagtttgatagggttcagtaacctctcggcccctagcccattcagtgctttacctccggtaatctaatacaacgctagccctaaagctatttcggggagaaccagctatctccgggttcgattggaatttctccgctatccacacctcatccgccgccttttcaacggaggtcggttcggtcctccatgggattttactcccacttcaacctggacatggataggtcacccggtttcgggccctatgcatgcaacttcacgccctattcagactcggtttcccttcggctccacgccttaagcgcttaaccttgctgcatacatacgctcgccggaccattctacaaaaggtaccatatcacactttgacgtgctctatgtgcttgtaggctcagggtttcaggtgctatttcactcccctcccggggtgcttttcacctttccttcacagtactattctctatcggtcactggggagtatttaggcttggagggtggtccccccggcttcccacggggtttcacgtgtcccgcggtactctggatcctgccggctgtctctgtctttcgcttacgcgactctcacgctctccggtctgccttcccatacagttcagctagacttcaacataccttatgcagtccgcaaccccgcacacattgctgcatgcggtttggcctcttccgctttcgctcgccactacttacggaatctcggttgatttctcttcctcgccctacttagatgtttcagttcaggcggttcccctgacatacctatggattcagtatgccatgacggatcgttacatccgccggattgctccattcagatatccacggatcaaggcttatttgcagctccccgtggcttttcgcagcttatcacgtctttcgtcggctcccagtgccaaggcattcaccctgtgccctttgtagcttgaccatgcttgaatcttggttctctttcggctttattgcagtgcttatacccttgtttcatgatatttgcattacataaaactttgttgcagatttgtttcattgttcaattttcaaggtgcgttaccaaagccttccggctttgttggtggagatgaggaggatcgaactcctgaccccctgcgtgcaaggcaggtgctctcccagctgagctacacccccatattgacgcatgaaagcttcttttcccctttcggggtccagcgccttcaaaaatgaacaacgagctttcctgtccctgtctgaccagagtccgccggctctccgccggcttcgctccttagaaaggaggtgatccagccgcaccttccgatacggctaccttgttacgacttcaccccagtcatcaatcccaccttcgacagcgccccccttgcggttaggctactggcttcgggtgttaccgactcccatggtgtgacgggcggtgtgtacaaggcccgggaacgtattcaccgcggcatgctgatccgcgattactagcaattccgacttcatgcaggcgggttgcagcctgcaatctgaactgagacactttttcgggattcgcttcacctcgcggtgtcgccgccctctgttttagtgccattgtagtacgtgtgtagcccaggtcataaggggcatgatgatttgacgtcatccccaccttcctccgttttgtcaacggcagtctcattagagtgctcttgcgtagcaactaataataagggttgcgctcgttgcgggacttaacccaacatctcacgacacgagctgacgacaaccatgcaccacctgtctggatgccccgaagggcttcacctatctctaggctatgcatccgatgtcaagacctggtaaggttcttcgcgttgcttcgaattaaaccacatactccactgcttgtgcgggcccccgtcaattcctttgagtttcaaccttgcggccgtactccccaggtggattacttattgtgttaactgcggcacggaaggggtcagtccccccacacctagtaatcatcgtttacggcgtggactaccagggtatctaatcctgtttgctccccacgctttcgagcctcagcgtcagttaaagcccagcaggccgccttcgccactggtgttcctcctaatatctacgcatttcaccgctacactaggaattccgcctgcctctacttcactcaagaacggcagtttagaacgcagccaccggttgagccgatggatttaacattctacttgccatcccgcctacgctccctttacacccagtaattccggacaacgcttgctccctacgtattaccgcggctgctggcacgtagttagccggagcttcctctttgggtaccgtcattttcttccccaaagacagaggtttacaatccgaagaccgtcttccctcacgcggcgtcgctgcatcaggctttcgcccattgtgcaatatcccccactgctgcctcccgtaggagtctgggccgtgtctcagtcccaatgtggccgttcaacctctcagtccggctaccgatcgtcgctttggtgggccgttaccccgccaactggctaatcggacgcgagcccatctttcagcggattgctcctttggttgcaggggcatgtgcccccgcaacatcatgcggtattagcagccgtttccggctgttatccccctctgaaaggcaggttgctcacgtgttactcacccgtccgccactaagcttacattcgtccatccgaaaacttcaaaacgtaagctccgttcgacttgcatgtgttaggcgcgccgccagcgttcgtcctgagccaggatcaaactctttgataatggtattaaaaactcttgcgagcttccaatctttaatcaaagacgatccagcttcgtttcctttgctggttttgcttgtacgtccgtctctcgacggatgcactcaatttcgtttccagggtccttagcttccccttccggacttcctcaagcccttccggtttcgctttggttctttccttctcgttgttcatttttcaaggtgctgcttgtccccggcttgtgggcgtcaccctcaagcgggagctttagtctatcatgaattttcggcaaagtcaagcggtttttacaaaaaaatttaaaaaaatttacctgtataatttttcaacatgttttcaacattcaaacacgcctttccaagccagtttccaacaatttcaacaatttcatgttgaaaacaattttccgttcttcgcctgcatctctatcattcccatacaaaaaagaaaaaattcacaaaattgattgcaatccgtacaaattatgctatactatataggcatcagcttttaatcagtgagaattgctgtagcttatgcgcccgtagctcagctggatagagcgttagactccgactctaaaggccgtgcgttcgaatcgcatcgggcgtaccaatctggaagctgcactttagcctttgaaaagaggctaaagtgcagcttctcttttaccttgaccagtttacaatttttatatataattttatcaagagttcattattttgaccaatcctctgggaggttttcgtgacaaaggaacaggctattgcggaattttttcaatataatcaaatcgatccggcgcaaatttccagatatctcgatccgaagctcgagtatctctccgaaaaagtagaccagtggctggccattgtcgatccatctgaccgggagttatttttgcgcctgttgagccgatatacttatctgaccaacgaggcttctgtccggcggtatcatgagggtatccatatcctgacggacacgctgcaatccttgggcctctccctttgtgatttgttatttattacaacagaatcatcagacaagtggaaagcggggagtgatcatgttcgcacagatttgcaccgtttatgtatgggacaaatagacgcccgccagatcgtcgcttgcacgcgtaagctgtctgcagatgaactggacgactatcgcggttttgtctttgtggatgatattgttggcactggcttcatcctgcttcggacaattttatcttttttgaatcaatttccggattttattaatctcccgctttttgtgctttgtattgttccgacggacgcgggtctctcctatcttatcggacagttgaaaaaaagaggcgtcaatattaacctgatttataatcaggagtggatcgccgtccctgcgttccagcgcacggatatcttcgcgatttctgagcgagccgacgctatagcgcggatccgcaaatacgaagttttgattgatgcatatatgaaggagccaaataaatcatatatattgggcttttggggatgtagacagcttgtatcattttactataatacccctaataacacattatgcacattttggcgctggactgatacgcatacgccgctgtttcctcgggaaaagcaacctcaaattcagttaaagtacttacaatcggtgaagcgaaaaaaggacaacaatgcatacaaaatcaaagctgagcaaagggcgaatgcaaaatggacctaattgattattttgatcgtcagttgttgggttatctgcgcgcacatcccgatatgctgtttcgcgatgcggcccgggcattgggcgcccatacaatggcggtagaccatcgtatccaaaagctcatgtcgctggggtttctttctatggaacgccagggaacttttcgtctgactgaccgggctttgacaatctgcacttcgttctcaacgccaatagatgaggccccgatttcttcagagttttcttggacggacctttatattccgctaaacctcacattagaataaaaccgggaacgatcagaccggggtgaattcgccccttgatcaaacggcactaaccactgtttgccgtgcgtgcgtcttgttcatttcattctctgcgacgcacgcacggcaaacagacagatccattattattacaatttatttagtgatcgttcccggttttagatatattattgatgaaacgatgggtttgcaatggagccaaatgattatgtaaatcggctgcgtcatgcgatggagatctctgaaaatccccgattttcacccgagtatatcgcacagtgctgtacctacgcggaaaatttgctcaaacagggattacccgtcctatttgaccaaacacatatccgaaaggtgcttggcatggccgctccccgcctgtgcgactaccacaggttcaccattcccaaacacaatgggagccggatcatcacggctcccagccgcaaactgaagctccgtcagcagtggatctatcagaatatcttgatccgaaaagaagcttccccgtatacccatggctttgtgcctgagcggtctattgtgacgaatgccatccttcatatcgggtatgcatacacatactgcgtagatatcacagacttttttccatccattacgaaaaaacaggtcctgccgatcttccggaacatggggtacagcggatccgccgccaataccctgtgtgatttatgctgttgcgatggcgtactccctcagggcgctcccaccagtccatatctttcgaatatgatctgccgcgatctcgatgatgagcttggcgcaatggcgcggcgcttccgtggcatattcactcgttatgcggatgatatcgcgatctccgcaaatcagcagcagccccagcttctggacgcgctgggattgatcttgggcaaacatggcttttcgatgaatcttgataaatgcagaatatacaatcctggacagccaaaacgcattaccggcctgactgtacataatcgtgtcagcgtgccaaaggcttttaagcgtaaattgcggcaggaaatccactattgccaaaagttcggagtcactgcccatttggaaaacacaaaggcggcacgctctatacattaccgggagcatctttatggaaaagcatactatgtcaaaatggtagaacctgaattgggggcgcattttttagacgagttatccaaggtggattggcccgagtgaccatttgttactgttgcaggcatggctcgcatcgtttggggaaaatccatggttaaagattccggtatcgttcaaagatgtctaagaagaatttatcttccttgtattataaagctgacatttcagtgcgtgtggattgagaaatccacgcgcgcttctctttttttaccctgttctattgctgtgaacgcgggcgctggtttatatatacaaattgtttgttcaccatttgttcatctctacaaaatagatcgtttatatatatttttttgcgcagccgcttgacgaacgcgcatccataatttagaataaagcagaccggtcaagtaggaaattttccagaggaataagtgaggagggtttacggcgaatgattacattttttgtttgcctggctttactgattgtcggtttctttacctatggaaaactggtggagcgcgtattccatattgacgaccggcagacgccggctcttgcgcatcccgacggcgtcgattatgttccgatgaaaacttggcgtattttcctgattcagcttttgaacatcgcagggcttggccctatctatggcgccctggccggcgcctgctggggtccgcaggtctacctgtggattgtgtttggcaccatcttgggcggcggtgtgcacgatttcctttcaggcatgatgtctgaacgccatgacggcgcttctatctcggaaattgtcggcacatacatgggcaaggtcatttcttttattatgcgtgttttttccgttgtcctgcttttgttggtcggcatcaacttctcggtcggtccggccgcgctcatcggcatgctgactcccgaggttctgaacacatcgttttggctggctgttatcatgatttattacctgctggccaccttcctgccaatcgataaaattatcggcaagatttatccgatctttggaatctgcctgatcatcatggccgccggcatcgcggggactctcctcctgaacccggcatattccagccagatgcccgagctgtggaattcgcttgcggtcgttcaccccaccggcctgccaaaatgggccatgatgtttgtcaccgtcgcctgcggcgcgatctccggcttccatgccacccaatctccaatgatggcgcgctgcatgacttccgaaaaggaaggccgcaaggtcttttacggcgcgatggttgctgaaggcatcatcgctctgatctgggcctgcgcgggcgtcaccttctacaatggcgtcggcccgctctcagaagccatcagcgcccttgggcagggcacggttgtttacaatatttccaccaccctgatgggtccggtcggcggcgtgctcgctatgatcggcgtcatcgcctgtccgatcacatcaggcgacacggcgtttcgttcctgccgtctgaccattgccgactggttccgcatcgaccagtccaagacttcctaccgcgccgctctttccatccccctgttggcaatcggcgcattcaccgccgtcgcccttccctttgatattctgtggcgctacttctcctggtccaatcagacgctcgcaatggtagttctttggacaggcgctgtatttcttcataagttcggcttcccgccggtgtgctgctttatggccgcgctgcccgccgctttcatgtccgcggtcagcatgacctatatccttcaggctcctgaaggcttccggctcgccacctccatcgcctatcctgtgggtattgttttcgcgctcgcatgtctggctctctttatcttccagacctatgtccgaagcggtaaaacggcgcagcccacagtgcagggcaactcctgatagcactgtttcaaacataataagccgtacggcgcgcatggacctcaccatgcgcgccgtacggcttttctctgaggcgtctgaatcagcgcccggctacagcctgattttggcacggaaactttctctgaaacggttgatttcctcttgcggatatagtacccttttaataaatactccaacaaagtttgcaggtgaatctaattatgcatctaaagcgactggccgctctggtggcggccgtctgtaccctgtgggcattgcccatgtccgtcctggccgctcaaacacccggtggtctggatatcgatcaaacaggcgatttggtcgatggcagctatgtataccgttcgtctgtaacgcttacgctcttgccggagcatccgcaggacaccttgctcatcgaggacggcggcgtctggatggagctgacgccggataaggagcaaaattatacgctcacctttcgccagccgcgggaatataagcttcgtttttgtactcaggcgccggacggcacgcgcggcgaacctcgtgcggaaagctttacaatcgatcctgtgcttgcgcagctgatcgacgacagtcgcgcgctcccgaaccttttcacggcgaccgacagcgaggtggaggcgcagcgtgaaaaaattatggacgtacagtcgcgctggagcgatttgactgaaagtcagcgcgcactgttccctatctcagaacagcatcgcctgacaaaacttgtcggctggttgagcaatatgcagccggctatcgacgtgctcgcaccagatacgcccacagtcgttttgaccggagcaaaggcgccgaataccaatatattttcgggcaaggtggatgttgaagtacgccctgcgacgttctatgatttggagcttgtctgcattcgtgaaaacgatggatggcaatacatagaaccgacggacggcgtgtacacagtatcgtttacaaatcccggcagctacgcgtttgatgtttgtgtgcgcgacgccgcaggcaatcacagtccggcccggcgcgtcgcctttacaatctccgatgaactttgcatgtatttaacaagggtttccactgctgccggcgcagacgcggaagtagccctgattgaatattacgccatgcccgccgcactgcgcgcgcaggtggatgctcaggtgatcgagcgactgcaaacgctctgcggatggcaatatgatgcatacagcctcggctggcaggcgtccgccggggagcgccctgtacgtgccgtcggcatgcttggcgcgttcccgcagggcagcgtccgattttccgtgaccggcgcgccacgcagtcagtccctgcccaatgtttccaaacagacgctgtacgcttattctatcgcttttacaggcgcggacggcgccgccgctgtgccgcaggctcctattttgatccgcgcggtgcttccgcagtctctgcttggaaagaaaggcgttcaaatatatgatgatacgggcgcgccgctggagacgcgtgtaaaaaacgaggacgaagggatcgtgcttgaatttacggttgcacgggcgggcgcttattatatgaccgcggatgtgtgaagcgccccaaggcgctgaaagggccggttccagttggaaccggccctttcagcgccttgggggcaaggggcgcggccgggggcctgcctgcgccgcaggcaggcctcagacaaacgccaggcggcgtttgtctgtcctgcgcacatgcgtgcgcaggaccggccgcgccgccccctcccccatacttttaaagcgcaggggtatcgcataccgtttcattcgaaaccttcccggaatcctttacccggtttcggcgcgaccgccatagcagaccgcagccaatcagcatcagcaaaatctgtgcgaccggcagagaaatccacacgccatccatcccgatcatgcgcggcaacacaaaagccagcagcaacgcaagcaaaaccgcctctccataaaccatcacatatgcgggccggttgtgctgcgtcgcataaaaatatgcggttgttacacggcaaaacgcaatcgggataaaaccgattgtaaagacaggcatcgccttggcggccatcgcagccgcttcgcctgaggcgccgaaaaacacaggaatcgccgcgcgcaaaagacagagtgcaacgatattggcaacagccgtcaccgctgcgaaagcatacgcaagattacgcaccgcctttgtccgttccggccggtccatgccaaaatacaggctcatctgcggttggcttccatcacccaccccttgcaacagaagcataacgacagccgttgcataagaaattacggcatacgcagctacggatgattctccaccataaacagatgccgccttattaagaagcataattacaaagagcggcgacattgcaagcccaaacggagaaacggctgtgcgcagaatcgagccgcacatatgtccggccggcctgaccggaccgcttccaatccggaaggtcacgcgccacagataaaaagcgcatggaaccgccgtgacaatctgtccaatgaccgtggctccggccgcgccggccatcccccacccgaatacagaaacaaacagcgcatcgagtacgatatttgtgacaaacccagcgatcattgcgcccatagctgcaagcgcgccatcgtaatttcgaatcagcggcgcaagcgcggtagcggcaagctgaaacggtatacccagcaaaatcacacggagataaacgatcgcctgttcgagcacttcaccgcgcgcgccaagagcagcgagcgccggcgtgccgaatgaaaaaagactcaccgcaagcagaacgccggcagccgccagcagcaaaaacgcccctcccagatgtccgcgttcgccgcgtgtatcgccgcggccacggcaaacggaaatacagactgccgctcccataccaatgcctgtaccggccgcctgaagcagcgcagacagcggataggcgatattgacagcggccaaccctacgtcgccaacactgcggccgataaaaaagccgtccacgatcgtataaagtcccgaaaatgcgaaagcagccatcgcgggcagcacttgtttaaaaaattgcttgaccataacaaactccctgttttctgttagaataaagatagtataaaccttaaagttacttaaatgtcaagcccctcggccggcatccggtcaatcgtatctttcaaatttgtgaatgctcaatgacagaaggtggatatatgataagaacctttgatttcatactcaaggcaaaatataacagggcttttatggaacagcttgaaaaagctatgtcgagcgagcagagcagtgaactatgcacggatacgcacaggctgacgttttatcctcagtcaaaactgattctcattgcgcctgcatcagacagcagtgtttttcactataaaattgttccgaaaaagatgacctatcaggcattttttaaaatattgcatggaaaatgggaacagttggacgccgatgacgtagctgatccataaaaacccgcatactctcattcgccgttttattcaggagtcatcggctgacctgttcttctaaaaaacaggtcagccgatggcttaggagcatttgataatcatgcgcctgtccgcaaagcaggcaatgtgcaccaaaaacatctgctatgccgctgttttcaaaaaatgccgctatcttggaggtctatgatgaaaaaagacgattgtatcgctgctgtggcgcggctgtttggcgtcgcaccgtcggcgcttcgctattgggaccgcatcgggcttgtccggtttgagcgtgatgagcaaaacaattaccgccgtccctgtgttcagacaatgctggacatctccaatgttctgctgttccggcggctgtccatccccctgcgcgatatacgatcgctgccggatatggacgccagccgtctcgacgccctgctcgtagaaaatgaacaaaagctttccgcacagattcacgagcttgaaaacgctatcgaacatatccgtgcgatgcgcggcgcaatagcacgcctggatcatctgcgcacaagtgcgattacactgataagcgaccagcttccggcaatccgtccattttcttttgaggatgaggccagcgtacaaacatatgtttacgatgtgcacgaatcaggtatcgtaatcccgcaaggcggcgcgccgtcctatggaatcttctgcccttcggaaaccagcccgcgcccggacgcgctaaaacggcgggacgacgtgccgcgcaactattggtatggactgctgcgcgtcctatcggatgatccggcacaaaacagcgcggctgattttactgcggccgcacaagcaatggggtatccggttggccccttgtatggacggtttattgtttcagcgcatgaggagggcgcgctgtacgattattatgaagcatggctcgatataggacaattttcataagcgcgcttgtgattaaatgtaaaatatgatacaattattgccagatggcttgatttcctttattgtcctatatctgtattttctttgtcagacaaccgcttttggcggataaattcagaaaaaggagcggtcatatgaagtttcagtattatattccaacgcgtatcctctttggcaaagggcagttaaatgccctgcacacacagcagctcccgggcaaaaaggccctgattgtaacaaccggggggcagtcagtcaaaaaattcggttatcttgaacgtgtcgggcaggagcttgaccgcgcgggcgtcagccatattttatttgacaaaatcctgccgaacccagttaaggaacatgtcatggagggcgccgcgctcgcaaaagcatcgggctgtgattttgtcgtcgggctggggggcggcagcgcaatcgattccgccaaggccattgccatcatggccgccaacagcggcgactactgggattatataaacggcggcagcggcaagggcctgcccgtaccgaacgatcccttgcctgtcgttgcgatcacaacgacggccgggacgggtaccgaggccgatccatggaccgttatcacaaaaacagagacaaatgaaaagatcggcggcggctacgacaagacattccccgttctcgcggttgtcgatcccgaactgatggccacggttccgccgcgtctgaccgcctatcagggctttgacgcgctgtttcacagcacggagggctatctcaacaacaccgcctatgtgatgagcgatctttacgcgcttgaagcgatccgtttgatcggcaaaagcctggaaacggctgtcaaagacggctccaatctggatgcgcgcgccgacgtggcgttggccaacacgctagccggtatggtggagtcaacctctggatgcacctccgagcacagctttgcacatgcgctcagcgccttccatccgcagtttgaacacggtgcggcgcttatttccgtgagctgcgcctattacagccattgggcgaaaagcggctgctgtgacgaacgcctggtgcgcatggcgcgcgcccttgggaaaacagacgcttccaaaccgtccgattttgtcgacgcgctggctgcgctgcaaaaagcgtgcggcgtcgacgatatccgtatgagcgcctacggcgtacagcgcgaacatctggagcagtatgtccaaaacgcgcgcgccaccatgggcgggctttatgcagtcgatcccgcgccgctttccgacgatgacgtgcgcgcgatcttcgaagcctcctatcgctgattatgtgcaaaacagaccgccggggccggcatagagccggtcccggcggcttggggccaagggcgcgccgcttgtgcggcacgcccttggctgtttgcgggccgcgccatgcggcgcggcccgcaaacatgcgaacgctcaggcgagccagcaggggcgcagcgcccgcatactggtattgacgagatcagcgtaatacacaaggcagtcgggcgaattttgtgcaaggcgcagcgtgcgcgcatcaaccacaagcagattgtgattgaagccgccgctgccggaccgcacctgcaccagatcgccgacacgcagagacgccgcagttggtacaatcatcgcgccaaaatcgccggcgcgcatcgcatagtcccagaacttcccgacattttcccatgcgggcgaaccgccccccgccccggcaaaccactcgtccgtcatcgccgcgccgccctgcgggctgtcgccgccgccaaagccggcgcggatacattgagaggtgaaattggcacagtttccgatccagtcgccgatatcgtaatacgcgggattgggcggctgcatccatcgggcggcataggccgccgctgctttcccatcatacagcgccgcgcccgccggcgcccccggcgccgtatccgccgccagacgtgcgaattccatgcgcaggcgttccatcgccgtccggttcgacggcacagcaggcacagcctctccgaaccgccgcgaagcgcccggatactcgtgcagcgtcaccttccagccgccgctgtcccggcgcaggcgcaccgtatgctgcgcatttaccgccagcattggcggatatgcctgcccggcttcgcctgttattataaaatgaaggtccatctccccctctccgggcgtgccgagcgcctccatccgcggatccttcaactcgctttcatcaatccatacaatcgtgtatggcagcgccctgactggcacataacaaagatggctgttcatcaaaagccgccttcgctggatcagcagccgcagccagagcagttcgtttttgaccgcgcggctctctgcgtccgccaccgccgacagatcgagcggctccatcgtcaaatacgattcatactgcccttccaggtaagcctgtactgccgcctgcggatcaagcggcccgtccgtttgataaacgcgcgcgccggtcaaatagccctgccgcaagccgaccgcagtctgttcgcgcgccggatccgctggaatcccgcgggcaatcgcgcaggccactgcaagcgccgccgcaatgaccgtcaggcgtcctttccccatttgctcacctcctgctttatctatatgcgcatatggggccatcttttccgtgcggttagaagcgtaccggcgcgctctggagattttttctgtgaggccattgcatcccttcctggaacatgctacaatatatagcgttcgcatagtgcaaggaataccagatcatgttgggggatcaaatgatgaaaattggcaaaaacgcgctgaccgttttggagcggcgttatctgaaaaaggatgaacacggggaaaatattgaaacagtcgagcagatgttccggcgcgttgctgatgcaatcgcttcggccgacgccgcttacagcggcaagactgacgttgcggcactgtcaaaccgattttatgagatgatgacaaatctggagtttttgccgaactccccgaccttgatgaacgccggcaaggagcttggccagctttccgcctgttttgtgctgccggtgggcgattcgatggaggaaatcttcgaagccatcaagcaggcggccttaatccacaaatcgggcggcgggacgggcttttccttctcgcgcctgcgcgcagccggcgcgaccgtgcgcagtacgggcggcgtggccagcggtccggtcagctttatgcgcgtgttcaatatggccaccgaggcagtcaagcagggaggcacgcggcgcggcgcaaacatgggcatcctgcgcatcgatcatcccgatatcctggagtttatcgactgcaagaaaaataacgccgacatcaccaattttaacatctcggtcggcatcaccgaggaatttatgcaggcggtccagcagggcaatgcttatgaacttgtcgatcccaaaacaaagcaggcagtcggccagctcgacgcgcgcgaggtctttgacaaaattgtggaaagcgcatggcgcaacggcgaacccggcattatttttctggatcggctcaaccgcgacaacgtcgtgccttcgcagggcgagatcgaaagcaccaatccctgcggcgagcagcccttgcttccgtatgagtcgtgcaacctcggctcgatcaaccttgtcaatatgctcaaatgtgaaaacggcgcatacgccgtcgattatgacaagctcggccgcaccgtgcgcgacgcagtgcattttctcgacaatgtgatcgacgtcaacaaatatccgctcgcggaaattgacgttacaaccaaacagacccgtaaaatcgggcttggcgtgatgggctggtccgatatgctcgcttatctgggcgtaccttacaattccgacgaggccgtcgcgctcgcccgccgcgttatggagttcatcaccaaaaccggccgcgcagaatcagccgagcttgccaaagtgcgcggcgcgtttccactgtttgaaaagagtatctatgcgggcggaacgccgcttcgcaacgcgaccgtcaccacgattgcgccgaccggcacgctttccatcatcgccggctgctcctcgggtgtcgaaccggtattcgcctatgtctttatccgcaacgttatggacggcaccgaaatgatcgaagtcaaccctgtcctcaaggagatcctggaggcgcgcggcctgtacagcgacgggctgatgaaaaagatcgccgccgaaggctcgctgcagcatatcgaggaaattccggccgacatccgccgtgtatttgtctgctcgcacgacgtaagcccgctttatcacaccaagatgcaggccgcgttccagcagttcaccgacaacgctgtgtccaagaccgtcaactttaagcacgacgccaccattgaagacgtgcgcgaagtctatatgctttcctatgagcttggctgcaagggcgtcacgatctaccgcgacggcagccgcgacagccaggtgctcaacatcggttccgtcaaaaaggagggcggcgcccctgccaaagccgaacagccagccggttttggtcaaatcaagccgcgcccgcgtccggaggtcacctgcgggctgacggaacgcatgaaaatcggctgcggcaacctctatgtgacggtcaactacgacgagcagggtatctgcgaggtattcacctcgaccggcaaggcgggcggctgcccgtcgcagtcggaggcgacggcgcggctcgcgtcgattgcgctgcgttccggcgtgtctatcgacgaaatcctcgaccagctccgcggcatccgctgtccttcgaccattcgtcacgcgggtatgaagtgcacctcctgcccggacgcgatcgcgcgcgtcatcaaaaagacggccgacatgatcgcgctccagcagggcctgcctgttgccgcgccgaatgcgccgtgcgcatcctgtgcggcggaagcgccagaaacgaccgagcacggttcgaagttctgccctgaatgcggaagcgcgctcgagcatgagggcggctgtgtgagctgccgcagctgcggatattcgaaatgcaactgacaaaaaaatgcccctgccaaaacagctttttggcaggggcattctctgccctcccgctatagacaaagcgccgttgtccttgtaaaaggggctggtttttcgataaaaatcctgctacaatcaggatggggaatttgcagcattcggatggatctttccccgctttggccaaacgaaaaaggaggcaaacagcttgtgaaacgctttctgtcggttctgttccttcttacgctgaccgttgccggcgcggcatgcggcggcgtttccatacatacgcacagcagcgcctctccggcgcctgtgcaaagcggcaccggagaaactgacacgtccacagcgccgcaggtgcagactgtctccattgaattccccgcatataccgaacccaaccctgcgcagcttcccgctgtcgagcgaatcaattccgccgcaaagtttcaggtggagctggcgctccccgcaggctggacagtcggccaaacgccgcccaaggatgtggtccccatccccggtgatttttatacgccgctctccatttcaagcggggacgaacccattggctatatcggctttaatgtttttgaacctttcgacggcgatatcccgcaggcggagtattataaggcggtttaccccggcctgcgcctttcttcctttttccactgggatccatatacggcggtcaaagccaccgatacggcggaaaccggcgtggcggaaatctggtatctcgatcccaatgaaatagacaagcaccctggcgcgatgccggacgtcccccatctggaaacctatggcgtgctttcttacgacaagcggttgcgcgtttatatcgggattgcatttgtgccggacatcctggaccgcgcgcaggtacaggcaatcgccgaaagcgtcacactgtctccgattggataaacacacttgcagttccacaaactccaaacttatgaaaggcggtgcggcacatgaatgtcagggagattgcaaagcttgcgaatgtttccattgcgacggtgtcacgtgtgatcaaccgcccggaggtcgtccagccggaaacgcgcgcacatgttctttcggtgatgcgcgcccacaattacaaccccgccgcacgcggagccgccgcgcggaccggctctatctgcctgctggccgagcacgccggcgattatcttatacaacgcctgctctttggggtggaaagtgtggccgcacggcgggattgttccgtttacctgtgcggcacgggcggccgcccggaggacgaactgctgcgcgcggcaatcgggcagcggttcgacggcctgattatctgctcctcctcgctcggtgcggaaagcgcggcgcgccttgtaaacgcgcatatgccatttgttcttgcggaacgctgccctgcggccgcgcattttaacgcctgctacgtcaatttcgaggaaggcgcctatcgcatggcgcgccatcttctggagcttggcagaaaacgcctgtggcttttgacaaacgagcaccggcccaatgtcgcggccagtatgcaggaggggctgctgcgggcgcaacgcgcagccggtcttgaacctgacggcggccgtgtcctgcgcgcgtcggaaaacggcgtgcacgcgggttatgaagcggcgctcgaggtcctcgccggcagcttgcccgatgcgattttcgcagccagcgacgaactggccttcggctttatgaaggcgctgcttgagcatggggtcggcgttccggatgaaatcgccgtcacaggctttaccgactccccaaccgccggcatcgttacgccggagctgaccaccgttgagcagccgacgcaccgtctgggaatggtggcggcacgtatgctgtttgacatgatcgacggaattccggccgcggacaccacaccgcaggaaatcgttttgctgccaaagctgaaaatccgcgcttcctgcggcaaccggaggcacatcaatacattgtttgagtaaagtgtattctggaaaggagggcacgttgatgacaaaacccatatcctttatggggctggcgcttaaaaaccccctaatcgtcgcagcaggtccatggtccggcggcgctgcagctattcaaaaatgcatcgatgcgggcgcggcggctgtcattacagaaacgatcgttatggaggaaccttggcttttcagtccgcgcatctactatcatgacgacgagctgctcaatctttcgctgtatggcaagcgcacccttgaggagtgggaaggcgaggttgaacgcgtccgcaaagacagctgccatctgatttgcagcattcgtgcctcaagcccgtcggagatcgcctatatcgcccaaaggacagagcgtctcggcgccgacgcgcttcagcttgacctttacgcgcctatggattcaatgatcgaggacatccaccttcagccggaaaagctttatgagtttgtgcacgccgcggccagcgcagtctccattccggtcatgacgcgtctgccgtacaatctggccgccagcgcgccccatctgcacgctgtggagcgtgcgggactgcgcgctatctgtgcgattgaaagcctgcgtgcgctttccggcgtcgatctcgagacgcaaacaacccttatgccgacctacggcggctatacgggccgccacatccggcccatttccctggctgcgaccgcgacgcttgcacaactgaccgacctgcccatctgcggtgttggcggcgttgaggattaccgcagcatccttgaatttatcatgctcggcgccgccgccgcgcagctcggttcggctatcatgctgcacggttatgatctgattaccaaaaccgtgcgcgcgctggaggactggatgcaggcacatggatacgacgattacagctctatcactggggccgctttgtcgtcgcttaccccgtttgaaaaggctgtgcaccgccgcgccgtctgccggatgacgcagccttgcagccgtaccggctgcgggctgtgtacgtgcggctgcatgtacggcgcgcttgttatggagcctgacggcgtgcatctgaactcctcgcagtgtaccggctgcgggctgtgtgtccagcggtgcccgcagggactgtttcacctggaaacgttctgatatgaaggccgcccgacattccacaaggcaatgccgggcggcctttatttaaaagtttagaaggggcgggggcgcgcgcgacccgtgcgcgggtcgctcaccgccggacgctgcgcttgcccggccggctattcggggctttccggcggctacaagccgccgggcgcgaacaagccgcggcagcgccccttttcgcacctcacgggacaggggccgggccgcccctgtcccatggacccaaccccggggcaggcgcagcctgtatacgcacagcacccgccccactgttcgcggcatagccgactaaagtttttcgccgaggcctttttaaaaaaaggccgaaaagttttttgccaagcttttttcaaaaaagcgggaaattattcgacctgcttatcggggaggattaggttcaggataatgcctgcgatcgcagcgacagcgagtccgccgatgctgatgccgccgggaaagttgaacgttgcgccgccgaccgcaaggatcaaaattgcgctggagacaatcaggttcttggctttggagaagtcgacatggttttcaacaactgtacggacgcccacattcgcaaccataccatacagcaggatgcctacaccgccaagtaccggatcgggaatggagcggcagagcgcctcaaatttcgggataaatgcgaacaacgccatccagacagcgccgcagcggacgacaaacggcgaataaatgcgtgtgaccgcaagcacgcctgtattttcactgtgaatggtgagcgacggaccgcccagacacgcagaaacacaggtggcgcagccgcatgcgaacagagagcgcggcaggcccggatttttagtaaaatccttacctactgtcgtgccgactgcgataacatcgccgatatgttcaatacacggaacgattgccgcgggtgcgattgcgatgatggcgcgcacatcaaatttcggcagcgtaaagcttgggacgccaaaccaggcagcctccatgacgccggaaaagtcgacgagtccaaacgggattgagatcagataaccgccgacaagcgcgagcacgatggtcaggattttagtaagcccttttccaaagatattgacaacgaccgcgatgccaaaggtgagcagcgcgacaggccagttggccgaagctgaggatacgccgaccgacgccaggctgaggccaagcacaatgataatcggaccggtgatcaccggcggaaataccctgtttatacgttctgttccgagcagcttgagcagcagggcaaacagaaaataaaaacacatgacgaaaacaaggccgccctgcgcataggggatgcccatatccgtaatgatcatggtcagcggcgcgatgaaggcgaatgaaccgcccagaaacgccggaacaatccctttgtcaataaactgataaatcagggttccgatgcccgcgcaaaacaatgtcacagaaacgtttagcccgcagagtatcggcacaatgatgacgccgctcatagccacagtgttttgaagccccaaaaataccatctgtttttttgtaaaattgacggacagatcgcttggcgatacgaaacgcgcttcccccacgcggctgttttggttatcctgcataatcattccctcctcaaaaaactgatctcagcttgcattgaacgcacagtaaaattccgccgcgcatccaaaacgttccagcgggattttttccaccagctcacgcagcggcgtgcagccgtcgggcgatgtggggatcatctcgtcccccaccctttcaatgatctgcgccttggttgcgggaaatgtgatcggacgcatggcgatcacaatataatgcgttgccagcaggtatggaatttcacgcatcatactcattctgttcacccccataagtataggcattgtattggcagcgcgtttcgccgtgaccgcccaaatcatggcacgacgcaccgcggtgccggaacgaatacaaaaacgtattggtcacgctgctctcatgaagcttgtcaaccaagccaggatacagatccgccttgacaatataggggacgccggccggcgcctttgtaatgacgttgccgtctggcgcaacaatcatgctcattccaaatgcagagcatgccgcctccacaccgacacaattgactgcgacaacatagcactggttgcagtaggcgcccattttgtttgtaatatcccaaccgttttcccagggactcatgtagtgggtcggccgcacgataatatttgcaccgttataagcggcttcgcgccaaatctcgggataatcgccatcggcgcagacgattgtcgcaatcttcgatccctttgggccgggcgtgaccgggcattcccatccggggtagtgccgctctgtcggaatccatgggttcattttgacgtaccgatgtacgacctcgccctgatcgttgatcatgatggcgcagttgccggggctgtcgtgaccatcgagcttgagaatcacgctgaaaatgccccatacgcgcaggcgcgcgcaggcctcacgcaggcgggcgacttcaggcgaatcgagtgtcaaaacgacattgagacgcttggtcgggtgcatcccctgtactgcgaattccggggtaacgaacaggtcatagccaggaaacccgcgcgcgcctgtctccatgtactggatgattgtatcgatgttgcggttgacctcctccatgcaatccgcatggataggttcgagttgtgcgcagacaacgctcaatacttctgattcaaccttgcctccgacgccgtgactgcttccaatgatcatgaaaacccctccttttatgaaacaaatatgtaacaggacttaaacatcctgttctcaagactgattccaaaagatattgctgtaaaatttacaaaaatatctttacttttataattaattgtgttattctttatgtaacaaaatgtaacacatctccgaatcaaagtcaagtacgaatctaaaaaatcatgctgcggcgtacccaaacttataacaaggtattaacaggagggaatgatatgcaactgttgattcaaaacgcaaggctgcgaggccgcgacggcacagttgatattcaaattgaaaatggccgtattaagcgcatcgcgccaaaaattgaaggcgtgcagggcgagatcatcgacgcgcgcggaaaattgaccacaccgtctctgatcgatccacatatccatctcgataaggtcaacgtatttgatgttgtccggccaaacaaaagcggcacgctcaaagaagcgattgaaatcctgtgggaccaaaagcgcatctacaccatcggcgatattgtcgcgcgcggcgaggacgtagttaaaaaggcgattaaaaacggaacgctcgccattcgcacgcacgttgacgttgatacaatcggtggcctgcgtccgcttgaaggcgttcttgcgctgcgtgaaaaatataagaacgtcatcgacattcagatcgtggcctttcctcaagagggtattgtcaaggatcctggctgtgacaagctgatgtgggaggctatggaggccggagccgacgttgtgggtggtatgcccgccaatgaaaactgccctgccgacagccttgcgcatgtaaagctctgttttgacattgccgaaaagtacaacgctgagattgatatgcatgttgatgaaacagacgatcctttttaccgcacgcttgagatggtcgcggatgaaacgcttgcgcgcggctggcaaaaccgtgtgacagcaggccatacctgtgcgttggctgcctacgacgatcattatgcatcctatgtgattgacaaggttaaaaaagccggcgttcatatcatcacaaaccccgtcaccaatctgatgctccagggacgcggcgacaagcagccgatccgccgcggcatcacacgcgtcaaggagctgcttgcggccggcgtcaacgtctcctacgggcaggattgtgtcaaagacacattttacccctatggcagcggcgatatgctccaggtcgccaacgtggtggcgcatgctgcacagatgagcctgccggatgaaattgaaaaggtctatgatatgattacatatgacgccaaccgcatcctcaagctcgacggctacggaattgaggagggctgccgcgccaaccttgtgatcgtcaatgccgacgacgcgcgcgacgccatccgtttgaatccggagcgtctctatgttatccgtgacggccgcgtcgttgccaaaacggtggtggacacacagttgttcctctgatttgtcattacttcttctatcccatatcgccgcaggggccggccgctcgatcgagcggccggcccctgcggtctgtacgcgttttatataaaataaaaagcgcaaaaaaaattttagccgattgctccacaaacaatgtgagctgcgtgaaaaagcagcggcaaccccgcaaaacgcagggctgccgctgctttttctttattatttttaatcagctctggatattcgccggcggaaatttgctgacaagcgcctgtgcaataccgccgatcaccggtatgttgtacgcttgataaccatacgatttgaccatggcaatgatgctgaataccagaatcgcgatgccgaccacaagagagacgatcccaagtacactaagcacgccgacggtcgcgacagccgatcctgcgacaacagccgccccggcgccgactaccgtcaggatagtgatgagcaccgtcactacaaacgagatcaggttcagtacaaacgcctgcatcgcatggaatttgacgaggccgctttccttttccaggaatacgatcacaagcggcagaagccatgcaacatatttgacgaccggtatcaatccgccgacaaatgtcacaagataacaaagcaatgccatgatattggcatccagcccgccgaggctggagcgatgcggttgataagtgttcatttctgggatcctcctcaaatgataatttatcctgttgcaccacagcaacaaggccggttttggctgtgatgcaacatgcgcagtccgctgctttgcagcggttgccgccgaacggtagctgcaagcagcaaaaccgtttgcctcgcgcatattgtatcatatattgacgaatctgaaaagctgcgtcagtaaaaatctagtaaaggcgagccaaactgttatttttcacaaaatttcatatccttttaatacgacattctgcgataaccatggcaaacatttttccaacatgacgccataccgtgtgtctgttccatagctgaaggtcgttttaatggccaattcaataaagcgcgtcgcgcgctccatggcgatcgggaaactgtcgccgttcatcatcccgccggtcagtacgcttgcaaaaatatcgcctgttccgggataggacgtgggcacataatcgtaaggcacccgccaataggcattgcgcgcgcggtcatagcctacgttcacatagcctccctgcatcgtttcaacgcctgtgatcacaacgtattgcgggcttaattccgaaagccgcgcaagcatacttttgagcgtctgccgcgtctgcggctcaaagcggtatggctcaccgagcaaaacggacgcctccgtcggatttggtgtaatcacatcggccgatctgacgagcgcgcgcatacgcgccatcagctccggcgtacaggttcggtatggccttccatgatcgcccataaccggatcgacgacagccagcgcatccggatacgctgcgataaacgcttcaacgtcgtctgcttgcgcgggacttgacaggaatccggaatacaccgcctcaaagccaagctccaaacgctgataatgctccagacacggccggatataatcggtcagatcgcgatattccacatcgcccagcccgccggtgtgcgttgacagcacagccgtcggtacaggacagacctgagcgcccattgacgaaagcgttggaataacaactgccagagagctgcgcccgaatccggccagcccatggattgccgcgacacgcggcggtcttttctccatccttctctctccttcccgctttttttaaaaaactttgcaaaaaactttccggcttttttgaaaaaaaagcctcggcaaaaaactttagtcggctgcgccgcgaatcgtggatcaggctctgatatttatataggctgcgccgcgaacagcgggccaatagccgcgtttataccggctttccagcctgcttttcgcttcttttaaccaaatccatataatccaaaaagcgccagcgatgcaaacttctgtttatctgtattttttgcaatagagccgcctgaatccgggcatactgttcatcaggggacgccggcgcgtcccgcgcattcccaacgccctgggcatgggcgcgtaaaataaacggaggtggtatcaatgaacaaatcgacgacaaccgcagtcaccggcgtggcaatggccgctttggcaggcaccgcagcttatatgctgagtcatcgcaaggcaacacccggcaaaaagctcaagcagaacactgcgaaagcgatccgtacgcttggcagcgtgctggatagtgttgaaacaatgatgcgctgaaggccgccgcaaaaaaggccgccgcccgcgccgccctcctgatttttagggcggacacgtgggcggcggctttttaagagcctgcttgcccatatgggaaacggatgcacgcaaagcacaactcatccaatctgaattttcccctccggcacaatcagccggcgcttatgcgtggagcgcgccgccagggacaggaaaaaggataccggaccgagacgcccgatatacatggaaaagataagaagcaataagcacaaagcgttcgcctgagcggaaatgcccgcggacaatccgacggtcgcaaaggcggaaacgctttcaagcaaggcgtcaacgcctgccacagcgtgcgtctcacgcatggttgcaacaatcgcgcccgctgtaatcgtaacagccagtacccccagaatcatcacagcgaatgatttatagacggcgctcttttccacccgccggccaaaaatcagagtatcctcgtcgccgcgaatcacactgtaaaccatcataaaaataactgccacagaggtgatcttgatgccgccgcctgttgagccgggagctgcaccaaaaaacatgagaacagacgacagaatttttgtcacaccgttcattccttcaatggaaaatacattgaagccggcggtgcggcagcttacagaatgaaaccatgccgctccgattttttgcatgggcggcatcggcccgagcgttgctggattcgaccattcaaaagcagctgtaaacagagttcctgcaaaaagcagaattgctgtagctgtcagtacaacgcgcgtatgcagcgtaagctgctttgtatggcggtattgcgacaggtcatagacgacgatgaaaccaataccgccgataatgatcagaaaaccgacaaccgcaatgacaactgggttggcggcataaccgcacagcgacagaaaagccgttttacggccaaacaaatcaaagcctgcgttgcagaacgcggacaccgccgtaaacactgcgacaaacacgccctccgctccaaattcgggtatgaacacaaacatcagaataatggcgccagctccttcgacaacggcggacgttctgataacaagacgcagcatacggtatacatcgggttccgaggaggcgaccgattcctgcgccaaatgcatcccgcgcagtccaagcttgcgcccgatcattacattgaaaaattgtgtcagcgtgacaagcccaagcccgccgatctgaatcagcagcaggataatcacctgtccaagcggcgtccaatgctgataggtatcatacacaactaaccccgtcacacatgtagcggaggttgccgtgaacaggcagtccaaaaacggcgtaggctgtcccgcgcggctggacgccggcagcatcagcaagagcgtaccgattaaaatgactgccgcaaagctcagggcaatcacacgcgtaggcgatgaaaacaagcggcttctgtggttttgtctctgttccaagcagtttacagcgcctttctttttaaaaatataaattacctctctgtgcggacggctggactccgtccggacagataacggcgtgcttcattgatcaggtgtttatcatttttaaaagtaaccatcgtatcggcctcgtcaagcaagcaccatttatattcactgatctcctcctcctgccggcgcaccgtatcgtctccgtcaggcgacgcaaggaaatagacaacctgctttttaacatgcggctttggaaaatattccacgctctgccgaaatccctcgcacagcccaacgtcaagccccgtctcctctttgatttcacgcagcgcagtttgcggctcagtctcgcccgtctccacatgtccctttggaaatgaccaatggccgccgtttttatgccggatcagcagcagctccagccggtcctgctttttgcggtaaacaagcgcaccgcaggatttctcgcgtatcacgatcgtttcagtcctttcaagtcaagcgcggacccgcgccccggttttcacatgcgccgcgcgcagcgcgggctgtacagatacttattaatatatcacgtttgtatctgttttaaaagtgaaatcagcaatttaaccgataaaaagcgacccgcactgtataccgaatgcggcgtctcttatattgcgcggttgacaagatgtcccatcttagctataataaaacggtatctttgcgcctgtagctcagcaggatagagcgaccgcctcctaagcggtaggtcggaggttcgaatcccctcaggcgcgccactaagcaatggtctggagccaactcgcgctccaggcttttttatttccaaaaaaaagcgcccgcaccctacgtatagtgggttcgaccgattgctgcaaaaacctgccgcacagtgcgtttgcggcttttagcggacttcaagagcgttttcatctccagatgcgctcttttgcggttcgcttttcccatacaaatggtcatcgctttcctctctttatggttgatgccataccgaacgatcttttattatccaatgcgggcagccatgcgtcaaagaaagtcttaaaaatccgcacatattttttccgatctgcctgggtaaccgctcctttctgcctgacggcacaaaaaagagcagccgtttttttgtgtgaaaatagctgctcatagttgatgtatcattttggggggaggttgggcttatctgcacggcaaactggaaacggttcatctgtacgggctttgcaattttgtttttatatagtattaccgctatggatctgcatcatctcaatgctctcccacaatggattccatcctctttaaatgttttcactcttttttccacttgagcaaaagcgccgagttcatgatgaccaagacagagccggcattatgtaccagtgcaccaaccacaggattcagtgccccgaagatcgccagcacaatggccagaaagttcagtgccattgagaaggtcatattcagcttaatggtggtcatcatccgcttagacaaggcgatcagatgaggaagttccttcacctcgtcgtccaccagcgcgatatccgccgcatccacggcgatatcgctgcctacaccgcccatagcgatgcctacctccgccattttcagtgcaggcgcgtcgttgatgccgtcgccgatcatacagaccggctctccggaacgctggactttgaggaagttccttcacctcgtcgtccaccagcgcgatatccgccgcatccacggcgatatcgctgcctacaccgcccatagcgatgcctacctccgccattttcagtgcaggcgcgtcgttgatgccgtcgccgatcatacagaccggctctccggaacgctggactttgtcgatataatccagcttatcctgcggcagacagttggcacgaacctgccgaatgtgaagttgcgccgcaatagcatttgccgcgttctcatgatcgccagtcagcagaacaggctggacctttagcgcaaagagcttgacgatgctattttcactttccccccgcaatgtatccgagagcgcgatatatccggcaaactgaccgtccaccgccagataggtgacggtacagccctgctccacataagcgtccgcctccactggggacataaaatcgattccccgttcatgaagcagctctgtgttgcccgccaggatcttttttccgtctactgttacaaacacaccacgtccaggaatcatctgaaagccatcggcgggagaaatagctggaccgctcgattttttgtagcagtccacaatggcttttcccaatggatgctcggagagaacttcggcagaggctgccaagcggtatagttctctgtcggtatataggtccgacaggctcttagccgctactaccttgggcgtaccataggtcagggtaccagtcttatcaaacgcgaccagcttcactctggccagccgttccagagcatcgccttcccggacgagaaaaccatgcctggcagcgttgccgatagctgccatgacagcggtgggtgtcgccagcaccagggcgcagggacagaacacaaccaaaatggtgacagcccggataatctgcccggtgaacaaccaggtcagtgccgctgccgaaagggcgataactacgatccaggtagcccagcggtcagcaatgcccacaattttcgccttacccgcgtcggccgattgtaccagccggatcatcctctggatggaactgtcctctcctaccttcgtagcctttaattcaaaggcgccaaacagattcagcgtgccgctggatacctcgtcgcccacgctcttgtccactggcagggattcaccggtcatgaccgcctgattgatggaggtctgcccaaaggtaatcactccgtctaccggaacgctctcgccgggaagcacccgaagcagatctcctaccctgacctcctgcgctggaataaccgtttccttcccattgtgcagtactcgcgctgtctggggcgtgagatgcaccagcttttcaatccccgccctggcttttgccactgtcagctcctccagcagagcgcctaactgcataataaaggccacctcgcccgcagcaaaggtttcacctatacagatcgaggcgatcagagccagagaaaccagtacatccgccttgatatcaaaggccgtgaccagtccgatgacagcctccaaaataatagggacgccgcaaagaatgatggcggcccatgcgatatcaaagggaaacggctgcacattcgccagactgcatatgacagcaatgccggagataaccagcagcgttatatcctttttgatgcctcccagctccaacagatgttccagcttctccatgagtgctttcataatgatcctcttttcattaccatacagggtataggtatataatacccatgggggtatatgttgtcaagaggataaaaagaaaaagcagttcaaatgaactgctttgcttatattctgtcaccccatgttggaaaaccgctctacggctttggtaaaactctcgatggttttgtccgcatctccatgttcaagaccatcccggacacagtgcttgatgtgaccctccagcactacctttccacagccgtgaagggcggattttgcggcgttgatctgagccagaacatcctcgcaggggacatcctcgtccaccatccggtcaatagcctgaacctgcccgataatttttttcaagcggcggtgcaggttttcggcatccatacattgtctcatataaatcatctccataccgttaagggtatctattttttatatgatgtcacagcggcaagcccgagagggcttgcctgccgctttgcggcagcgaaaccggctttgccggtttcggctgcggcgcaacgacatgcgcggtccgctgccttggcagcggttgccgccggatggcggacgcaaacggctttgccgtttgcatccgcgcatgtgataccatgtccgcgcagcggtatggtaaaattgcccgtcaaaaggtgtgggccgcctaagcggcaaatcgttgggcatcacccagtattatagccgtcccgcggttattgttttacaatggaatgcatcggtttcaggccctggatacgatctctatctgtgaaaaagtaatatttctggccttatctatgtggtcatattttttgggttcatacactttttttaccttaaattttacagtatcccctatctggaaccgctgctgcttctgcccccaatccgccagccaatggttttcatctggaatcggttgcgcacccaaaagcgagggaggcaaaagcccgtcaatacggtaataatgctcgcctcttgcctcgttgaaatacacgtctgagatatcggccacataaaaattgtccctgcaacagatcggatttcgttcctggggcagactgcctaaggaatagtattgatcctgatccacattaaatcggtcatggtcaaaattttcctgtacatagcgaatatgaggctcaaagcattgcccgcagaactcgtctcttaaatagcgccacagttcctgccgcgtatacatggggagaactttcgaatcgtaaagataatcaacataaaatgcgtgcgaggcatatatatcgaaaaaaacactacgcatccgcaggcagtggcctttttgctgttcgtttatcagcatatggaccttttcatttaacaggcaggccaccgcggcgccccattcggtcacagggccgtcccggcggtccagcatgacataacagcccatacagcgcatcaaagcgtgagacagggagcgcgggtccggttgaaatttcatccctaaattcatcgccctggcaatcgtctctttttcctcgctgttccattcgtttgtgtcgtctgattcgaacgattcatactgtgcatcgttcagatccttcagccggagaaggacctgctgtaaagttttttgaatatccttggataattttcggttccaatcaatgcccgtgcggtcgtatccgatatatcttatatgcctgtaatcggagggaacgtcgtccggtgaggcagtcaaaatgacgacctcttttttcagcgcatgggcaatgcccaattcatagttgacatttgggtttcttccggtgacatctgccagcacgattgctgcatgataaatggattggttgatgtcatctataatcggccggttattataaatctcatccgcccgcaaaggttccaggcccatcgcctcgattgccggtgcataaaccttcttgtagagttcatcaaagagatccccaaagggcatgattacaaaacaaagattatccatctgatcatcccgcttattaaattctccacctatacagattatagcaaaaaagatcgaaaaagaaaacaccctgttttggggatttataaaacgatctttttcggctgttgcattaagctgacaaaaatatccccagcaccaggccagtgtcttttcctatttttgcgcggcatggccttgtacccgctgccttgatatggtaaaatcataacatggcggcctgttcggcgcaccgccagggcggcgcaaaaagaatgaaaagaaagttggcgaatggttcatggatcagaacgtattggatcagattgttgcaaaaacgcgcgagctgatggatgctccgacttgcagcggcgaaacaaaagaggccgcgcagaaatggctggacgccgtagggacaggcgcgcaaaaagcacagactaaagcgtatattgaggagctggaagcggatatcatgccgattgacaacttgatcggctttgcaggctccgaggccggcgcggcctatttcggcgcggaaaaggccgctcaaatcgttgagcatgcagagcagatcaaggcggccggcgcgcggtactgcgactgtcccgcctgcgcaattgtcgcgcaaatcctcgaaaagaaggacgctctgctggcattataaaattcatctggatgaaacacccgtatttaaaaaaagcgggcgccggcccattctgtggaatgcggccggctttttttcaggcggcggccattgcctccgcctgaaagcagcgcccgagtggggttttgtgtcctgccccgcgtttaaccgattctgtcctcgggcgattgcacgattctttttaatttctatatggggggttctgacatgcagatcacggaggagctgatccacacgctcgcgccgaacgcggccgcgctcggcaacgccaaaaaaatcgcggcgcgcggcgattttatcaatctcggcaaatcggaggacggcacgtatttatgcggcgactgcaagggcagcggaaaaaatccataccatacctcggccgattttatcgatccggcggcgccggtgctccgctgcagctgcccgagccgtcagattccctgcaagcacgcgctcgccctcttgatggaggcgctcggcggccggacattcgcgccgtgcgatatcccagaggacatcctcgcaaagcgcgggaaacttgagcagcgcaaagcggccaaggccgccggtacggacgccaaggccgcgacgaaaaaaacaaatacggccacgctggccaaaaagatgcaaaagcagctcgagggtctttcgcttgccgaccgctttgtgagcgatgtgataaccggcggcctggcagcgctttcgggcggttccatacagacctaccgctcgctggcaaagcagatgggcgactattacctgcccggcccgcaggcgctcatcaacgccatcctgctggagctggaggcgctgcaggacgatcccgcgcgcgaggaggacagccgccggcggaccatcgaaatccttgtccaattgcacgccaccattaaaaaagcgcgcgcttttttgcagggaaaggtcgaaggcggcgccgtcagcatggaggattccatgctgtacgaccgcatcggctatatctggcagctttcgcagcttgacgagcttggcctttaccgcgacaatgcggtgctggcgcagctctccttcacaattgaatttgatgcggcgcgcgccgaatacatagatacgggctattgggtcgagctttcgaccggcgccgtctataaaaaggagaatctgcggccgctcaaggcagtcaagcatatcaaacaggatgataccgtgctgggatgcctgcaaatcccacgcctgtatctttatccgggcgaattgaaccggcgcgtgcgttgggaatcgtttacttcgcggccgcttacgccggccgactgcgcagccatccgcgcggcagcccggaccaatctggccgtcgcggtcaaggaggtcaaaaaccagattaaaaacgcgctgtcagaaaagacggccgtctgtctgattgcctatgagcagatcggccagacgcagggcatctgtgcgctgcgcgaccgtaccggcgctacagtcgagctgtgcgggcgcggttctccgtctgccaccgcctgtctggactatttgccggacgccaatctgctggaaaatcaggtgctggccggcaggtttttttacgatgccaaacgcggacgcatcctgcttgagccactttccatcgtcagcggcgaccggattgtgcggttgagcttttgaggaaggagtgtatatgaaatggctttgcctcttttgaatgaattgcaggagcgcctgcacgcgtgcgccattgccggtctaaacgtcatcggcgaggatttccgcctggcgcgggcgctcgagcagctcgcgcaggcacaggcttcctcgcctgtgctcgcgcgcatctatcagactgccgcgccgctggccgatcccgcctgcgctgacaaggcgtccgtgctactcgacgcgatcacgcttgtcgacgccgtcgtgctgacgcaggcaggctgcggcgtgcagggcgagctggaaccgatggccgccggctgtcccggcatcgattcaggcgcgcgatacagcgagctgtcggcgctttacaccgccctgacaacgcgcggcagcggccgctatgaaatcctgcgcacggcccttgatgagaaccgtcccgcgctgcgcgactttcgtctgatggaagcactcgccggcgcgctcggcgacagctacagcgagatcgccgacctggccgcgcggattctttccaccatgccgcaggccgtgccgctgctcaagcgcgggctggacccggcaagcaagaaaaaggacatggtccgccgcatcgacatcattcaggcggcagccggagcgcgtgaaaacgcgctttacctgcgtctggccgaggaaggctcgaccgttatccaggaggccgctgtgcgcgcgctgcgccacgacccggccaacatcccgcttctgattgaatacgttggcaaagccaagggcggcgtccgctccgcggcgcttgaggcgctttcccagatgcgcggcggccaggtcgacgccttctggcttgaccgcctgacagccgcaggcgtatcggccgataccctcaagctagtctatgggacggattcggatcttgtttcggacgcggtcgcggacctgctcgtccggttggccgatgaggcggacgccgcggactcgcagccatgcccgcaggagcgcgaagcgtatgtgcacaatctgttgcgcgccatcgtacataagacctcgcccaagctgttcgctgcgctcgaacagctcggcgcgtcgccggccatgcgcggcggatacatcagtgacgaaagcatggaccggattatacgcggcatgttcagcatttccggtatccccaatctgccgcccgcccgattcacaccgctgatggccgtcaacttccgcctgatacagacgatgctggataacccggcggcggtcggccctgtgcaggcgctttacagccgctgcggcgagccataccggatcgccggttttgcggcggcgcttctgactgataccgaggcggcttatgacggctttgagccgttctttggcgaccccggccagtcggagccgctgctgtgggtgatgcggacgctctattataacagcaaaacgggacgcaccggcatggcggttgaaatcagccggcgcaccttcactgattcgctcggcatccgctggctgcgcatgattttaaaatacggccactggcggcaggcgctcggccagccgcttaccgaccacggttatacggctccaagctggttttcccgcattgtcaatccgcatgatgctgaaagctgtgcgctgctaaggccctatctgctcggccgggttgggaaaagcggcgtgggctttgaaacgctctatgacctgcgccactgcgggcagcaggatttcagcggcctgatccccaagacgctcaaatccctcggcgccgcggaatctcgccggatcgggcggtatattgccgcatccctgtacgacgaattccccatgccggagcagacaaagcaggccgagctgacgcgccttcaggaggaatgggcgcgccggtgaataatctctgccgtatgcagatgccaaaaaacagaaaggacgaacccacgcatggccaatacagaattccagcgtctccccgcagaggagctttatcagaccgagcttgacgcgctgatcgccgccgaacaggaccctgttcccgccggctggcgcatgtcgccgcgttcggtgcttacctatattactggcggcaccgccaagggcgtggcgatcacgccgaaatatatgggcaaccgccgcctggtggaaattgcgattgcaacgcttgtcaccgaccgcgccttgctgctgatcggtgaacctggcaccgccaaatcatggctgtcggagcatctgtgcgccgctgtcaacggcgattcgaccaaggtcgtccagggtaccgcaggcacaactgaggaacaaatccgttattcctggaactatgcgatgctgattgcacagggaccctcgcgcgaggcgatgattaaaagcccgatttaccgcgcgatggagacgggtactatcgcccgcatggaggaaatctcacgttgcgcctccgaggtgcaggacgcgctgatctccattctgtcggaaaagcgcgtctccgtgccggagcttgcgttcgagctgcccgctaaaaagggattttccgtcatcgccacggccaacacgcgcgacaagggcgtcaatgagatgtcagccgcgctcaaacgccgctttaatattgtcgtgcttcccgcgccggccgatatcgaaacggaaatcgaaattgtgcgcacgcgcgtggagcagctttccggttcgcttggcctgcgcgcgcaggccccgggcgcagagcttgtcgaaaatgtcgtcacgatcttccgcgagctgcgcggcggcgtgacgcttgataaatcgcaaaagcttaagacaacctgcggcgtgctctccaccgccgaagcaatttcgcttttggcaaacggcatggcgctcgcggccagcttcggcgacggcgtcatccgggacggcgaccttgccgccgcgcttcagggcgccgtcgtcaaggatgaggagaaggacgccgtcgcctggaaggaatatcttgaaaacgtcatgaaaaagcgcggcgcaaagctgcgcgcgctctatcaggcctgcaaggagctgaacgcataatgcccatcctgttcggcgtgcgccacctgtcgccgggcggcgcgcaccatctgctgcgcctgctcgacgagatccgccccgagctggtgctgattgaagggccgggcgatctttcgacgctgatcccgcagctttgtctcgacggcgtgaagccgcccgtcgccattatggcttacagtgaaacggttcctgtgcgcagcatcctttacccgttcgccgtctattcgccggaatatcaggcgattctgtgggcgcaccgcaaccaaaaggcctgccggttcatcgacctgccgtccgggacgtttttagcgatggctgacgcgcgcgcgaagcgcatggaggaatccggcgccgggaatgacggggcggatgaccgtgagcagctcccggacgggcggtcgaccggcgctgtttacgacgcgctcgcgcgcctggccagcgagccggaccaggaggcgtactgggagcggcggtttgagcataacctctcggacggcgcgtatctgttgggcgcggcggcttacggccgccagcttcgggagactgcggcgcacacccgctatgaaacggccgaaaacgacgtgcgcgaggcgtatatgaagcgccgcatcaatgaggcgcttgcagagggctttgacgatgaccggatcgtcgtcgtcaccggcgcataccatgttgccgggcttgaacgctgcgcaccgctctccgacagtgaaacagccgcgctgccgtcgctgcctgcgcaaagcacgctgatgccctactcctactaccggctgtcgtcgctgtcgggttacggcgcgggcaaccgcgcccccgcctattacgagctgctttgggacgcgatccgccggggcggcgagccaggcgcggcaggctacgcgtatttgacgcggatggccgcatatatgcgcgcgcacggcgcaatcacctcctccgccgaggtgattgaggcagtccgcctggccggcgcgctcgccgggatgcgcggtccagcccttcccgtcctgcaggatctgcgcgacgcggccgtcgcctgcatgggacacggccatttttccgaaatcgcacaggcggcggccgacacggagatcggctcctgcatcggcagcctgcccgacggtgtgagccgcacctcgatccaagccgatttttaccgttgcctgcgggaattaaagctcgaaaaatacaaggcgttgaccgcgcagccgcttgaattggacctgcgtgaaaacacgcgcgtcaagtcggagcaatcaacctttctcgatttgaaccggtcgtttttcctgcaccgcctgcgcgtgctcggcgtccggttcggcacggtagccgcctcccggcaggaccgcgccacctgggcggaaaactggacgctgcaatggacgcccgaagccgagatagagcttgtcgaatcggccctgcgcggcgagacaatcgagctggcggctgccttcgccttcaaggagcggctggaagcggcccagtccatcagcgggaccgcgtctattttggaggacgcgtttttgtgcggtatgccgcgaaccatcgcgctggccaccggaaccctgcaagggttggccgtcgacgcggccgctgtgccggaaatcgcggccaccgccgaaagtctttcggcggctgtcaggttcggcagcatccgccggctcgaccccgcgccgctccttccaattttaagccagctctttctgcgcgcgtgtctcatcctaccgggaagctgcgcctgcgacaatagcgcggccggcctgcttgccgatgcgattggtgcgctcaacaccgttgcgcttaaccatgccgactgtgtcgacgaggcgcgctggctctctgtcctgaccgacctgtccgaccgcgacgacctgaatacaaagctttccggctttgcgacggcgatccttctggagcgcggtaaaatcacgaacgagctgctttccgccgaagtgtgccgccgcctttcgccgggcgtccccgcggagctgggcgcgggctggttcgaggggctttccatgaagaaccgttatgccctgatcgcccgtctgagcctttgggagcagctcggcgcatatatcgatacgcttgacgagacggaattcaagcgcgcgctcgtttttctgcggcgcgcctttgccgatttctctcccaaggagaaaaatgaaatcgcagaaaatcttggcgaagtgtggggcgtcgacgcacgcagcgccggcgaggcgctcggcgctgctttaacagagccggagcaggctgctttggacgcgctggatgaattcgattttgacgatctgtgaggtgcttgccatgaatactgcaattgatcccgcacagcgcctcgcgcgctggcggctgatcttgggagcgcaggcgcaagagcgcctggagcgcatgggcgcgtgcgggctgaccgaggaacagcttttgatggatcaggcgctcggcgccatctatggcggcgacgccggagccgacgcgctcggcggacgcggcgcgggcagcggcccgtcaagcccgcgtatttccaagtggctcggcgatgtgcgcgccctgttcgaccgcgaaatcgtcaccgtgatccaaagcgacgccatcgagcggcgcgggctgcggcagcttttatttgaaccggagctgctgcaaaatctggagcccgatatcgggctggcctccacgctgatgacgctgcgcgaccagatcccgaaaaggtcaaaagaaagcgtgcgcgcattcatcaaaaaaatcgtggaagaaatcaaccgcatgctggaaaacgatatccgccgcgctgtaacggcggcgctcaaccggcgcgcgcattcgccgctgccttccgcagccgcgctcgattataagctgacgattgaacgaaacctgaaaaattataatcccgatttaaaaaccattcttccggaacgtttctttttctttgaccgctccaaccgtacaaacaactggacggtcatccttgacatcgatcaaagcggttccatgggcgagtccgtgatcttttcttcgatcatggcgtgtatcctcgccagcatgaacgcgatcaaaacgcgtatcgtggcctttgatacgtccatcaccgatctgactgaaaaaagcgacgacccggtcgatctgctctatggcatccagctcggcggcggcaccgatatcaaccgttcggtcgcctattgccagcaattcatcgaacagccggccaaaacgctttttttcctgatcagcgatctggacgaaggcggcaaccaggccagtctgctgcgccgtctggaggatatgaaagcttccggcgtcacagtaatcagcctgctggccgtgtcggacagcggcagcccgtattacagcgcgcatatggcgcagcgtgtcagcgcgcttggcatcccctgctttgcctgcacgccgcagcttttgccgcagcttttggaggcagcgctcaaggggcatgatctcacagcgtttgagcgtatgaaaaagaaagcataaagctttacgcgcttagtcattttgcaatgcaaaagaaccgtaaaatagccgcgggataatctataaaaccccggctcgccataggcgggccggggtttttataagtaaccggggagcctgttccctcaaaccgtcatgcaccacgcgcttcgataaaaaacacggtgaactgttttccgttcggcagataataccggccgtccggcagaagcattgcctgcctgcgtgcatgattgagcgcctgcggcgcgctacagccgggcgaataatggcggataaaagccgccgcatcctccagggagtcagccggctgtccaaattcaagcgccgctgtcatgaatcggaacgctaatccgcgctcttttaaaagcgcggcgacctcgttggagcattccttttgatggtgtgaacgtccggacggcgcaatattacttttctgtcctgtattgacaacaacgatcagttgtctgcggcagagcgacagcaggcggtcaagcatcccctcatcggtcaagcggccaaaaaaacaacagacgacagcatcccacaggctgtccggcggcaggtcgggaaaagccgcctgtatgatccgtatgggcggcgcattgtggacagccgcctgcgcgcgcagcgctgccagcgcccgtgcatcgatatcgacggccgtcacctcgcgcacatagggggcaagcgcaagcgacaggcagccgaccccacagccaagatcgcacagcgtatcgtccggcgtcaggcccattgcaatcatctgcgccagccgcgcgtgaaaatcgctgtacgcggcagccgcctgataccagcgcacgccgtcctcatcccaaaaaaacatggttgtgctcctccaatcccccggacggttcgtcctacgcccgagcgccgcagcagcaggccccctttaggcctgcccgccgccaagcggcggcaaaaccggctttgccggttttggctgcggcgcccatgcgcgtccgctgctccgcagaagctgccgtcatctgacagcagcaagcaacgcaattgctctgcgcatatgatatcacacttttcgtttgcccgcaacgaaaaagcaggcgccccggcagccttgtaggaggccgccggggcgcctgcaaaagagagagtgttttggcgtagcagaattaccgcagcgcgagcggcgcgtcggtcacaataaccgggccgccgactgccgtggcaaagtgcagatacccatttgtatcgatgaaatactgcgaattttcgatcagcgtataaacgttggtcgaagcgtcataattgtagaagcgcagggtatttgtgttgagcgtcgacaggtccgccttgacggccacctctaccggcatcccgaacgaaccctggtgtgccaggtcgatgacaacgatgttattctggaaccacttggtgaacagggcctcaaccgacgcgttaccgacggtgataccggtcttgatatcggttgtaagcgtattcagtgccggattcagatacatgcgtccgataatctggccgctgcgcacagtgtcgaagcagaggatcgacttgacagtcacaccgctgcccgaagcagcctgcacagccgcgtcattggcggttttcagcagatcgggcgagatggacgggacgttggaatagaccgtgtaggccgtgccggacgtgccgccctggcctttgacggacgtcactacgccgccgacattcttcttaaccttactcgtcagatcggccgccttgatgacattgccgccgcctttgaccggggtcgtggccgcgccgcccttgttattcaggcgcgaaccgccgccactgctgccgccaccgccggaggagccgccgccaggattaacaaccgggggctgcggatcggggtcgggatcaggatcggggtcgggggttggacccgggtcctcgccgccctcaataccggcgtcgacattgtagttgctgaatcgcagatacgcgatttcggaatggtcaatcacagtgccgtccgcccatttctccgcgccatccatagtcgtgtaccagtagagcggttcatgtatcacaactgttccatcagacaggacgccgttgtgcatctgcggaatttcccgatcaatctgatccgcaaagctcttgaacgtatcgcccttttttcctgtgacataatcgaacctggtcgacagattttcggcggctacacgttcaaaggagacgttagcgcgatcgcccatgatatagatgtatgcatcggtatcgatgcgcgtgctgccctcatttttagttgtatagaccgtcccgttatatgtgaccttgagctgaacggaataggtttcctctgttccgggcagtgcaaccttgttgacaagcttcccgtccctgatttcgaacttagcgttatcaagataggtgctgtccgggtcgagttcaaacgtggccggcgtcaactggcgatcctcaccggtcgtttcgttccaataccagaactctaactcggagctgatctcgccgggcgcgtactcgccggtcttaaccggatagtccgatggagaagccgctacataatattcttccgtatactgattgtagctcgtatcctccttgaaggtcgctgtaaacgtgagttcgtctcccggattcggataataattatcaccgatatgatcactcagatcgaatgtttcgttgatcgcctgcccatcgctgcctgtgccggtcattgtgaccgtatcaatcgtatagccgtcagcagcgatgtaatcaatcgtcaaatacgcaacgcccgtatagccccccctgacgcgcaacgtcgtcggatcggtatacggcaggatggttgtttcacccacaggcaggatctttgtgggaccttccataccggtgtcgcccacggttgtgatgtcaagcacgccgtttttcgaggtgttgaccgtgactctgacatccttgtcggacgtaaccgcttcgtcggcgttgaagaacgcaaattcgctgaagctgtcaacggtgaactgcatcttgccgtccacgatcttgaccgggagcgcctcggcgccgtccttggcaaagtgcagggccatgatcgttttggaggcgtccaaccccttcggcaccggcagcgtaatggtcacattgccgccggactggtcaaggctgatgtcgtaaatgacaaccggcgattccggcacgatttcgacattcggaagctttgcgatttcctccctgacgctcgtctccgtgttggtaagtccctgatcggtgatggtcagggtcgcgccctcgggagcgccctcgatggagatatcctccttgttcatgccgtctggaacctcaatttcattccagtgcgcatacagagtaacgctgctctcgaataccttcgtattcagatcgaccttctgaccgccttggtcatattggcgatcataccagccgtcgaacgtataaccggcgcgcaccagctcgtcctctgtaaacgggcacgtgacctttccctcggcgtccgtctcggcggtctttgaaacaggcgctgtcccatagttcagagtgaacgtgatggtatacaccgcgcccgagtccacaggtccagaatccgtacccgaatcggccagagctgcgcgcgcggtatccgccgcgaccactcccaacgccaggctgaacaccatgaccaccgcgagcaccagggatagtgctcttttcattggctacctctcctttctaatttccccgctttatgcgggttgtaagatttgtatcccatctgcgtgtatcgcataaaatgagatattgactacataatatcacattaaaatatatatttcaagcatttcatcacattaaatgaaataacaatataaatttatcgattataatgactttaaattataattatgagaggttcttttgtgtgggaaactgaattttcggacaggctttgtaagctgcgcacgcagaaaaaggtatccgcgcgcgacatgagcctttccctaggccaaagtcccggctatatcaaccgtattgaaaaccgaaaggccctgccatccatgtccagtttttttgctatttgtgaatttctgggcgttacacccgccgaattttttaacgacgcgctcgatgcgccagtcctcctgcgcgaggccatcgccgaactgcgacggctgcccggcgacgagcttgcccatgttacagctctgctgcgtgatcttaaccggaaccggcagacctgatacaaccggcggcattggaaaacaacaggggcgtttcccgctttgagcgggaaacgcccctgttgttttctattattcacaatttgtcggttttcaacgcacgggacgcattgaggatcgctatgaacgaaacgcccacatccgcgaacacggcctcccacatgtttgccataccggccgcgccaagcagcagtacaagtgctttgacgccaagcgcgaacacgatattctgatgcacaatgcgcagcgtttttttcgcgatgctcatggctacggcaatttttgaaggcttgtcgtccatcaacacaatatcagccgcctcaatcgccgcatcagacccaaacgcgcccattgcaatgccgatatcagcccgtgaaagtaccggcgcatcgttgatgccatcgcccacaaacgccagctttccacgcggcgatttttccttcaaaagcgcctcgacacggtccaccttatcgcccggtaaaagctgtgcatgcacctcgtcgataccaagctctttggcaacgctttcgccgacagccttcgcgtcgccggtgagcatcacagtcttgcgcacaccgcgccgtttcagctctgcaatcgcttctgccgcatccggtttcagttcgtccgaaatcacaatgtggccgacatattccccatcgagcgacacatgcacggtcgtaccgatgcggtggcacggatgccacggcacgccggcctccttcatcagtttgtcattgcctgcacagacggtatgtccgtcgatttcggcacgcacgccgcggccggacagttcttcaacatcagatacgcgcgctgtttcaagctccttgccatacgcctcgcgcagagagcgcgaaatcggatggtcggaatagctctccgccagcgcagcaagttccagcagacgtgcttcacttaccctgtcgggatgaaccgccgttacattgaaaacgccctttgtcagcgtaccggtcttatcgaacacaacgatttccgcatcggccagcacctcaaggtagttgcttcccttgacaagcacgccacgtttcgacgcgccgccgatcccgccgaaaaagctgagcggcaccgagatcacaagcgcgcacgggcacgagatgaccaagaaaatcagcgcgcggtgaatccattcgttccacgcataaccaagcgccaacggcggcacgacggccagcagcgcagccgcgatcacgacggccggggtgtaataacgcgcaaaccgtgtaatgaagttttcggcacgggcttttttgctgctcgaattttcgacaaggtccaggatttttgcgacggttgattcgccaaagatctttgttacccgcacacgcagcaggccgcttttattgatgcatccgctgacgacgtcgtcgccgggctgtacgtcgcgcgggagcgattcgcctgtcagcgccgccgtatcgacagcggacgcgccctcgagcacaacgccgtcaagcgggattttttcgcccgctttcacgacaatcacatcgccgacagccacactgtcgggatcaacgcgctggagcttgccgtcgcgttcgatattggcatagtccgggcggatatccatcagcgacgcaatcgactgacgcgagcgcccgacggcatagctctggaaccactcgcctacctgatagaacagcataacggcgacgccttccggatattcgccggtcgcaaatgcgccgaccgttgcaagcgccatcaaaaagttttcatcgaatacctgtccgcgtgtgatatttcggacggcgcgccaaagcacatcccagccgacaactgcatatggaacgataaacgccgcaagccgaagcgtaccttccgccggcaacagcagcgcgagcgcaaacagtacggcgccggctcctatccgcacaagcatttttttctgttttttgctcatggcttagaatccccctaaataattgacctttttaaaggcagtattcccaaatcatccggccacaatttgcgcacgtccgcttggacgcgcccaccctgaaagatcgaaaaagacagcgcccgccccactgttcgcggcgcagcctgtataaacgtaccgcccgtcccactgttcgcggcgcagccgactaaagttttttgccgagctttttttcaaaaaagcgggggcgcagccgactaaagttttttgccgaagccttttttcaaaaaggctggagaatggtgcagtcaggttcgatctttcggcaggtcttgacgacctgcttcatgatatcctcaaagcgcgcgtcgtccgcgtcaacggtcatcttctgcgtcatgaagctgacggacgcgtcattgacgccatcgatccgcttgatcgcctcctccattttggcagcgcagttggcacaatcgagatcagccagtttaaattgctttttcatgttccagactccctttaccgttttatattgaaaaatttattccgcaacgtgctccatcccctggccgagaatcgtgcgcacatgcccgtcggccagcgaataaaatacggttttgccctcgcggcggtacttgacaagcttgctttgcttgagtgcacgcagctggtgtgaaatcgccgactgcgtcatattaaggagctgcgcaatgtcgcagacgcacatctcggactcaaacagaacgtacaaaattttaatacgcgtgctgtcgccaaagattttaaacagttcggccagatcatagaggatctcatcgtccggcatctcactgttaactttgttcacaatttcttcatgcgcgtggataaattcacagcgttcaatttcagcatccatgcaaacaccctttcatatgaaccattgttcatatattattatatacaaccgcttttaaatgtcaagcctttttcgttattttttaaaaaagcagcgcgcccgctatgacagcgggcgcaaaaaatccccggcggacgcttatggttcgctggggatcggtgatttgtctgaaaaacagggaacaacgtccgctctgaccgcggcattcaaacaagccgcagtcaaaattcaaacttttctgtttttcccttgttgttgcgcttttcacgctcggctgcgatgcgtgtcaggctatcgatatcggtgcgttcacggtcggcctcctcgtcgatatagtggctgaccatgcgggagagtcccacatcctcctcgatttcacggatctgcgttgtgaactcatagtcgcccggcacaagctccagcccgcgccgtgccgcggccatcgcctcctcgcgctgcttgcagtgatagctgatgcgtgaaagctggagccatccccacggatactccggatcgctccgcgtaccctggcgcgcatattgaagcgcctgctcataccggccgagatatgtcagcgccacagaatagcgatagcaccacacgccgctatttgcgccctgcttttccacattgcgcaggatttgttcggcgcgccggtacccttcgtatgtgtcaagattgatgtagacatatgcgatccagagcactgcttcaaggtcgttttcaagcgcacgctgtgtataccgccgctcacgcacgcctgcgtagaggtattccacaatctgatacagatagcattcctcgtcgagcttttcgatatgcgcgcgcatttcctccgtcaggattgccatgacaagcgcctcctttcactttcagggcgtttatgcttacagcccatcatctgacggctcatcggattcatagtcatcgccgtccgggttccattcctcatcgatttcaaacgcaccatcgtcattgcggaaatatgcggttccatacggcgcattcagatatggaaggatgtccggatcataattacagatggtattgagggtaaaaatgcccgacttttcgggatcatccatgtattcgtcatcctcatctccagcggtaaaacgccagccgctgtccgggacatcgctgtttggctcctcgcggtacataaaaccgaccggactgccgtccactgtgatccggtcagtcgcaatacagccgtccggaccatcccaatttgtgagcagctccttcatctcatcggcgctcttggcccattttttgcggctcatgaaagcgcagcagtcggggcgcgtcacatccatcaccggggaatatgcttcgccaaaccgttcgatgagcagatcagcgccattggccaccttaaactccatctcattttcataaaccggcaccatctgataaaaacagatccggctgccgtcgtccatctcgcaggcgacctccccgccgtcggcgtccggtccaggcgtggcgagcagaatcccgctgaagggcgtcccttcggcaaacggcccgccgttgggcacggtatgcccccagccgagccaggagttttcattgccgggcaagcgcgccatcaccttgagccagcgcatgggccagtaccatttttcatccttctcctgcaccttccagtccggcggcaggcaaatcaccatctccgcgcgatccagccgttcgcggcgcagctcgtccgggacgttcatccggtgcgcgcccatgcccattgtgacgagcgtgtaataattgcgcttctcatccggcgcgatgatcgcaatatcgacatgaatatccggcgagatcagctcgtggaacacgctttcataacggccgaaacggcgggcaataaacgattcaagccggtcaagctcctcacggctgtacagctcgggcgcgaaacgcacggcttcacggcggcccggcgcggagtcgtcagcctggctgttctccttgagatatttcgtctggcggccgcggctcttattctgccgatcggacaagcgcatcgcacggcgcagcatatcggcgcagtcctcatcacccggatgcagcgccagcgcctgacgaaaacaccgtgcggcgtcgcgggcgcggtcgagataataataggaatatcccatccggtaatgccacaggtaatcgttctttccttcctcctgaatagaaagaagttgcacagccgccttctgataccggcccagattgttatatgcgcgcgcgagctgtgagaccgcctcataatcgcgctctttttcatctatcgccaaaacggcatcgacaattttttgatattcatcggcctcatgccagaggtcaaactgctttttcatctcctgatccataaatccggtcccctcgctttggtttgccgccctgcggcgtctgcaaaccgctcctctttgatatataaagatacatccttcattataatcgattcccaggacaaagttcttccctaacaatgaattttttatgaataaactttaacgattacatgacctttacgcggtcctcacagcgctgtcctgccctcccggaaaaatcctccgctgccggtcatgcgctggcagcacagcgcatggaatcaaaagggaagggccgaaagccctcccccttttttcggtgcgctgcgcgaaacccgtatgcgcccacggggcatccaccagcaaaatgaagcggccatcctgtccgcaagcgtcaaaggcatccccaaatgccgcgcgcgtattcggcgacggtgcggtcgctcgagaacggcccggcgtgcgccacgttaagcaggcattttttcgcaaatgcggcgcggtccgcgtaatcgcgattggcgcgcaggcgcgtatcgcagtacggtataaagtcgtgcagcagaaaataacagtcgggcgcgtgccagcttgcgccgtcaagcagggcactgtaaagctcgcggaacatgccggtacggccgtcatcgagcgtaccgtcgatcagcgtgtcgacggcacgccggatgcgcatgtccgattcatacagggcgcgcgggttatagcgcccgtccagagcggcgatctccccgaccgtcgcgccaaagatatagttgttttccactccggcgcgctcaacaatttcgatattcgctccgtcaagcgtaccgagcgtcaccgcgccgttgagcataaatttcatattgcccgtgccgctggcctcggtgccggcggtcgaaatctgttcggaaatatcggcggcagggatcagtttctcggcgtatgagacattgtaattctggacaaacaggaccttcatacattcacgcatggcaggatcgctgtttaccagccgcgcgacctcattgataaacttgataatcgctttggcgcggtaatagcctggggccgccttcgcgccgaacagaaagaccgtcggcgtaaagtcccggatgcggccgtcctgaatcccaaaataaaagtccaggatggaaaacgcattgagaagctggcgcttatattcgtgcaggcgcttaatctgcacgtcaaacataaaatcgggacgcaacctgacgccctcgcgcgcctcgataaacgcacagagctgctccttcttctgacgcttgacgcgcaaaaaagcgtcgagcgcagtgggatcgccggcatacggcgcgagcttttcgagcgcgtccagatcggttatccagccgctaccgatacgctctgtaatcagcgacgacagctccggattgcaaagcgccagccaacggcgcggtgtgatgccgttcgtcttattattgaagcggtcgggataaagcgcgaaccattccggcagcgccgtgtttttaagaatctccgtgtgtattttcgctacgccgttgaccgaatgcgaggcaaaaatcgccatgtgcgccatgtggatcatctcgccgtcgatgatgcggtaccggccgcgtcccgcgccggtgatgccgcgcgccttgagcgcgcggccaagcgcgtcgtcaagcatgacgatatacggatacacctgcgggatgacggagcagaacaggccgacatcccatttttcaagcgcctcggccataatggtgtggtttgtgtaggcgaacgtgcgctgcacaaccgcgaacgactcgtcaaacgaaagcagataatcgctcatcaggatgcgcagcagctccggaatcgatacgacgggatgcgtatcgttgagctggatggcatattcatcggcaaaatgtgaaaaatcatcgccatggcgcgccgtataatcgcgcagcaggctttgcagcgacgcgcttgaaaagaaatattgctgcttgaggcgcaagcgcttgcccgccggcgtgtcgtcgttcggatagagcaccgcggagatggcctcggcttcgtcgcgcaggcgtacagcctcgctgtacttctgttcattaaagagcgcgaaatcaaatccctcgccgtcgggcgcctccgactgccacaggcgcagggtgttgaccatgccgccgccataaccgatcgccggcatatcgtaggggacggcgcgcaccgtttgaccggaaaaggtcacgaggacactctcatcatcgcgccgcacgctccacggatcgccgaagcgcagccaattgtcgggcgtctccatttgaaagccgttttcaaagtgctgccggaacaatccgtagcggtaacggatgccgtagccgtcgagcgggacgcccatcgaggcggccgaatcgagaaagcacgcggccagccggccaagcccgccgttgccgagcgcgtcgtcctcgatctgttcaaaaacagcgggatcaacgccgcgctccagcagatagcggttgcattcatcgagcaggccgaggttaaataaatttgcatgcacaagccgcccgacaagaaattccgcggaaaaataacaggcgcgctttttgcccggttcccgtttccactgcggccgcagccgctccatcgcagcccgtgagacggtgctgtaaagcgccgctggcgaagcggagcacgcttccgcgcccgtttcaaggcgcaggatttcgtcgatctgttcagtgaagggtttcatttcgttcctcccgctgcggccgcggcgcgcgtccgcaatgttttattcaggctgctgtaccgatcggggaaagcacatagacagggcgtgtgcgtctcccattggtacaattttttaaggatgcggcggcacgacaggacggccgcagcccgcacgccaggcggacacagccgcccggccgagactcgcgcgcgaaggcgcaggcgggtccggccggccagccgttcccggcagacggccataaatctttgtcaggcggcggatggcggcgcgcagtcccgcgccgggttcgcccgcgcgcatgcgccacatccagttgccgccgagcgtcgacggcgtgttgatgcgtccctgcgcgcccaggcgcagccagtcggccatggggatgatcgccgtatcgcagacgctggaaagcgccgcgcgcaccattgccagcgtaaaatcagcgtcctcgccgacgcccagatattcacgcgcaaaggccacgtcgtccggcggcgcgctttcgatccagtcgcgcgtggtggtattgtcgtgtgttccggtataaacaacgctgttgcgcgtgtaattatgcggcagataatcgctttcctcacggctgtcaaaagcaaactgaagcaccttcatacccggaaaaccgctgtcagccaacagccggcgcacctcgggcgtcaaatagccgaggtcctccgcgatgatggaaagccccggcacctcgcgccggatcgtttcgatgaaagcaagtccgggtccaggtttccaatcgccgacagccgccgtttcagatcccgccggaatggcgtaatagccggcgaagccgcggaaatgatcgatgcgcaccgcgtcataaacgcctgcggccgcgcgcaggcggcgaatccaccaggcatagccgtcggcggcgtggcgtttccagtcgtaaagcggattgccccagagctgcccatcggccgaaaaggcatcgggcgggacaccggccacggccgtcggcattccttcactgtccgtttgaaaaagctcgccgtgcgcccacaggtcggaggagtcgggcgacacatagatcggcagatcgccgacgatcaggacgccgtgtgcgtttgcatacgtcttgaggcgttgccactggctgaaaaagagatactgcactgccttccaaaaacgtacgtcgtccgaaagccgggcgcgcgccgcagccagcacatccggctcgcggcggcgcaacgcctccggccacgcataccaggcgttcatgctgcagtcagccttgatcgccatatacagtgcgtattcgtcaagccacgcgtcctgcgcgcggcagaaggccgcaaactccggtgcatcgccaagacggcgcgccgcgtgccgcaggacgtcgaaacgatttttatacagtctgccataatcgacggcatccgggttgtccccaaagtcggcggcagcctcatcgcgcgtcaaaagctcctgctcaattagcagatcgaggtcgatcagatacggattgcctgcgaaggcggaaaatgattgataggggctgtctccatagccggtcggaccgatgggaaggatctgccagtatgtctggccacactcgcagaggaaatcgacaaaatcaaacgcggcctgcccgacagtcccaatcccgtatggcgacggcaggctgaaaacaggcatcaggataccgcttgcacgtatcaaacagaactcccctttccggccattttttcaaaaaagcctcttaccttttttgaaaaaaaggtaagccaaaatactttattcggctgtgcccccgcttttttgaaaaaaagctcgggaaaaaactttagccggctgtgcccccgcttttttgaaaaaaagctcggcaaaaaactttagtcggctgtgcccccgcttttttgaaaaaaagctcggcaaaaaactttagccggctgcgcccccgcttttttgaaaaaaagctcggcaaaaaactttagtcggctgcgccgcaaacagtggggttgggcgccgcgcttatacaggctgtgccgcatacagcttctttctccgtccggcggctgtgactgcgttccttttgcagttaaagttcgctgatatggcagacgatctcgctatccgaaacatcgagcacaccataagtccggccgccgccgcgcggttgccccagacttccgggattcatcaggtaaaccccattttcatatttgacatgcggaatatgcgtatgcccataaaggatcacatttgccccaacttcctgtccggcagtcaagagcgcatccaacccgtattttacacagtatatatgaccatgcgtataaaaaatacgcgccttcatgcagccataaaatcccacggacgcctcgccgcttgcataatcgcaatttcccggcgtctgtaaccatttcacatttggatatatttttttcacagcggccagctcctgcgcgccgtcgcccagatggataaacaaatcggcagtttttttatgcatcaacaccaaacgctcaagcgatttataatcgcggtgcgtatcagaaaccacaatgattcgtgtcatcaaaaaatggacctcccgccgcccgtataaaaatcgggcgccgtcagaatccgggaggcattcccggcgtgtatccgcgccggccaaccgccgtgcgcagtcacacaatttcgaatatctgctattaatataacatagaatggaacgaaagaaaacaggcggtgactttgattgaacaacaattttaatctttccccggaacagaccgacgcgcttttatccatggccagcaaaaagatggggattgatccggcggatctgcgcaggcagatgcaaagcggagatatgagcggcgtgctcagcgggcttgcgcccgcgcaacgcgaccgtatccaaagcttgatgcagaatccggcggcgattcaacagctcgtacagaatccaaaggtccaacagcttctgcgcggcctgatgggcaaatgaaaccgaccattttttgatgattttccgtagccttttgccatccggccataccgggcgcacagggaatcgaacaacacggataaggagatgcagacggtggatgatctgaattcgacacttagcgccattctgggcgacccggccaagatggaacaactgcgccaagtcgcgcagtcgcttggcatcggaccgggcacaggcgcgcctggcgcaggcgcgtcggatgcgggcgccgcaaacgccgcgcccgccggcgggcaatccaatggacagggcggcggtatcgatccaaacgccatcgcctcgatcctgcaaaactttcaaaatgccggaaacggcggcgctggcggcgcggcgtccggcacaggcgccacgccggatcttggcgcgatctcaaagcttacagggattttaaattcctttaaccaaagcgataagaatgtcgaattgctgcgcgcgctcaaaccgcatttttcaccggcgcgcgccagtaaaattgacgacgccgtgcggatcatgcagttgattcacgcatggccgagcgtccgtgacagcgggctgctcggcagtctcggcaatcttttctcaggggggaatcgatcgaaatgatgcgatggaacagtacaaagacgtataccgaggaggatatgatccgcatgcagcaagaggcggtcaaccgtgtgcatgaatttcagacgcgcgcgcgggaagcggccgcctattacgatgtgcccgtatccgacattcgcgacctgcccgccccggtggaatcagccgccatctctgcggacaacacgcccatcgaggcgcaatccgaaattgtatcgaaccaatcccccccacatgcgggcgatccgctgcatggactgctggatgggctgaatctcgacagcgaaaccctgctgatcatcggcctgctgtttttgctttataacgagcacgccgataatgtccttttgctcgcgcttgcctacctgcttttataaatcctcatcgccggccggcccccgttgtttgagcgccgctttgtaaagcgcgcccttcgggtggccggtctgttttgcaatatcgcgcgcggcctgtgacagcggcgcgccctgccgcgcgcgctcaagaagcatgccaaccgcctcgtcaaaaccagccgcctcatcgcgcgccggccgcgcgccctccacaatcagtacaaattcgccgcgcggcggattttcctcataatattgtacagcctgtgcaagcgtcgtcctgtgcacctgttcatgcagctttgtcagttcgcgcgccagcgtgacgcgccggtcgccgaaggcggacagcatatcgcgcagcgttgcgcacagcttatggggcgcttcataaaaaatcatcgttgcagtctgcgtgcgcgcctgctccagatgttccatgcggcttgaacgcttgacgcttaaaaagccttcgaatgaaaaccgcgctgtggaaagtcctgaaaccgccaaagcggcgaccgccgcgctcggccccgggacaaccaccgtttcaacgccgttttcagcgcacagccggacaagatcctccccaggatcggatatacacggcatgcccgcatccgtcacaattgcgcagtcctcaccgtccaaaatccgcgtcaggatcatctgcccgcgctcgcgcagattgtgctcataatagctgaccatcggctttttgatctcgaagcggttaagcagcctgagcgtcacccgcgtatcctccgccgcgataaaatcgacggcgcgcagcgtatccgccgcgcgcggcgacagatcgctcaaattgccaatcggtgtgccgaccacatataatttccccgccatatccgtcctccagcttcctcaattaagcgtcattttccatatttatacttcatcagacgcgtttgctacaaaatcaactccatgaaaatatccgcgtacggattgtcgtgatacggcgttgtctcataaaacccgacgcttttatacagcgcgatcgccgcggtatcctgcgccctcgtatcgagcgccgcccgtctgtagcctgactgcgccgcaaaggacagcgcgcgtccaagcaaacgccgcccatatccccggccgcgctggccgccgtcaacaaacagcgttttaatctcacacaaatccttttacgcacgccgcacgcctaccgtacccaggacatgcccctgcatgtcccgcagacaccagaatctctggccagcccccccataggagtcgctgattcgcgtcagcggggcatgtcttccccgcggctcaaagctgcggcctgtttttggaatgcatgattgcaaaaatgcaaatacggcctcctgcatatccggctcaaatattacaagctccatgcaatcccctcctggaagtaaaagaccggaaacccggcgcctgtcatgacttttgccagtgcaagccctgcctatggacgggtgtcttgcggcctgcgggccgctcacagccggctgggcaagcgcagcctgtataaacgcagcaccaaacccgctgttcgcggcgcaacctgcttaaatcccgaaacctgtcctactgttcgcggcgcagcctgtttaaatcccgaaacctgtcctactgttcgcggcgcagccgattaaagtttttcgccgaggccttttttcaaaaaggccggaaagttttttgccgaggcttttttcaaaaaggccggaaggcgcgtcaaaaaagcttgggaggttcgatggtcatggaagggcggccgccgcggcgggcttccagtaaaaagagccagggcgcgtgggcggcgctgtgctgaaccatacgcaggcgttttggctccaggccgtgcgcgcgcattgcgcagaccgcatccgccagacgttcgggcctctggcatatgcacagcctgccgccgaaccgcagcaatcggctggcagcggcacagacatcctccagcgtgcagtcggtttcatggcgcgcggtccgtgcgcccggcgcttcgcttagaaggccacggcccgcagctttatacggcgggttacaggtcacaaggctgaacgctccggccggcaatacatcctgtaaggcgcgcagatcggcatgaaccggaataaagcgaccggcgggcaggccgccatgggcaaccgaccgctccatcagccggacggcgtcggcctgaagctctactgcatatgcgcgtgcgggggccggctgcccgccgcagaaccaccgcgccgcaaccgtcccgcaaccgctgcccagatcacaagcccattctcctgtgcgcggagcggcaaattctgaaagcagcagcgcgtctgttccaaccttgtgcgtgcctgaaacatacagccggatcgtcccaaacagttcaaatgtgtccacacagcccctccccttgcaaaagaaaagcctccgctttaacagcgaaggcttgtttcttatgtacgccggtcccttattcgggcttgatcgcctcgctcgggcagtcagccgcacaggccccgcactcgatgcaagcagacggatcgatctcgtacttgccgtcgccctcagaaatcgcgccgacagggcaggtatctttgcaagcaccacaagagacgcacgcatcaccgataacatatgccatggggaacacctccaaaaaaaaatactttttccgaacgcgcactgcgcgtataacaccactgcacacaacttgcgatgttacaagcctattttaccacagtcccgcgaaaatgcaagtgaaaatacaagtaaagttttctggcaaatcaaaaaaacgtggcctgcgtttttattcctctgtttgatcctttgcctgcgcgcgctcatgaccctcgcgaatcatgcgcacttcatctttatggtaaaatttagcggcggcctgatccttctccggcgctaccttaagcataccagtcaaaagatttacctcaatcacagttccgcggccttccttcgtgcgcacgactgagccgacgcgcggtgttgtgcgcaacagatcctcataggcggcctgttcatattttaaacagcacatcaagcgcccgcaggtgccggaaatttttgtgggattgagcgacaaaccctgttccttggccattttaatcgatacgggctgaaattcaccgagaaaggtcgaacagcaaaacggccggccgcagatgccgatgccgccgagcatttttgcctcgtcgcgcacgccgatctgccttaattcgatacgcgtgcggaacacggacgccaagtccttgacaagctcacgaaaatcgacgcgcccatccgcagtaaaataaaatagaattttgttgttgtcaaatgtgaattccacatcgaccagcttcatattgagcttatgccgcgcgatcttttcttcacacaccttgaaagcatgcttttccttcgccgcattttcgccgacacgcctcatatcctccggcgtagcgattcgcatcaccttcttgagcggcttgaccacctctttatctccaatggtgcggttgcccattgcaacctcgccgcattccacgccgcgcgccgtctcaacaataacatgcccgcctttttcaatcatcaggtcccccggatcaaagtaatagaccttgcccacgcttttaaacctgacacctataatttcagccattctattcctccagtttcaaagccgtttcaaggtctattcgcgcagacgctcaaacggccggacgccggttcagccaagcgtcgatttgatctgttcaaccatacacgcgcacagcaaaggcacgcctgtattgcgctcggcacgaagccgcgcagtttgtacgatctgcgcggcagcgaccgcctgacccggcgaaacgcggttggaaaagcgcgcatccgtttcacggccaagcgctacctgggcaaatccttcacgcaacagcgccagcgtttggccaagcgcagcgcggtccttgtcatatgccgccagaatacgcagcgccgtataacggtcgccgaacacaagcgcctcccgcagcaggcgcgcgtcagccgcagccttcgaaggctttgctgtttttaaaagcgcgcgcgcctgtccgatattcccggcggctccagccgcggcagcgcgccgctgctcctcgggtacgtcaggctcaagtgaggcgagcgccgcggcgcattcgtcgggcgaaggcgtttcaagctcaacagaaacaacacgcgacaaaatggtcgggagcatctgtgcccggttttcacacaacagaataaagtaaacaccggcaggcggctcctcaataatctttaacagtgcattctgcgccgacgcgttcatcgtatgcgcctgatcgacgatgtaaaccttacacgcgccctcattcggcgcaatatatgcatcctgacggatatcgcgcgcaagctcgacgggaaattcctttttcccctccggcacggtataaaagcgcacgtccggatggacgcctttttcaacctttatacagccggaacaaacgccgcatggccgcggcgcgccggtacacagccgttcctgagcgatcagggcggcggctgtttttttgccgcagccggccggtccttcaagcagcagcgcatgtggaaaccggccgcccgccgccagcccggacaacacggcgccggcccggcggttataaagcagcttttgcatcagagcttttcaaaccgttcaatattggttacaaagattgtcgccccgccgacctgcacctccactgggaacgaggtgtacatgcccacgccgtacgaggccgaggacggcaccatctgcgtgcgcttttttgagtgcatcccaatgatgcggatcacatcgtcgacacggtcgtcgtcggtgccgatcaaaaatgtcgtattgcccgccatcaaaaagccgccggttgtcgccagctttgtgaccgagtatttattttttgtcagctccttggatacacgcgaactatcgtcgtttgaaacaatcgcgaaaatcagcttcatacagtcgccctccaattgatcggccgccgcacatggcgcgggtggttgccgccgtccggcggccgcaaacagcttttctgtttgcactgcgcatattatagcacaagccgcgtcgaaatccaaccctttcgcgtcgtcaagaaggacttgtcaaaaaggacatcccaaatttggtcaaaacaggcggctcctctgtcccgctgttcgcggcgcagcctgtgtaaattgccggatcctgtcccgctgtttgcggcgcagccgactaaagttttttggcttacctttttttcaaaaaaggtaagtttcaaaaaagcgggaggacgcagacagtgcggacgctgtagcgccgcagggccgcggcggtgccgctgtcgatgcgctcgccgggcatgacgaccgggacgccgggcggacagggggaacaatcgcacgcggcgacgcggcccgcgcagttttccacaggaatctgctcgcgcggggaaaacagcgccgcgcgcaccgaaagcgcccgctcgggcagctttggcgccgcaggcggcgcggcgcgtcccaccggcggccgcaggccgtcgagagcggcgcgcagccgctcaaaatcacgggcgtcgttttctccgtccgccatcaatacgcaggcgctcccgctgatatattccggctccacgccatagatgcgcagatgcgcgccgaactccccggcctgatcgccgcgcgcgccaaaacagagcgacagctttgccgggtcggataagccaagcggcagggcaaagcccttttgcagcgcaaaatggcgcagcgcgtcaaaggcgcgcgccgtgcgatcaaacccttccctggccgcaccgccggccgcataagccacggcccgttcacaggaaagcataatcggatagcttgggcttgtcgaaccgaacaccgacatcatgctctttgcgtccccggcaaaccgctcctgcgaaatatgcagcagcgcgccgcccgtcatcgcaggcagcgtcttatgcaggctgtcggcgcacatcgaagcgccgcacgcgattggatgcatgtttccgtaccgttccggcaaaaaaggcaggtgcgccccgtgcgcgttgtccaccagcagaggcaccccccgcgcgcggcacaccgcagaaatcgcagccacatcgctcataacgccaaagtagtcgggcgacgtgatataaacggccgacgcctccggatgctcggccaaagccgcttcaaccgcctggggcgtgtaccggccggaaaaccaggctccggcgctgccgtcaggcatcacccatacaggcgtaaggtcaagcagggccgccgcattgattgcggcgcggtgcacgtttctgcccatgaccaccgtcccgcccgcgccgcacgcaagtgcaagcatcgtctggatgcagagcgtcgcgccgcccgcacagagcagagtgcgccgcgcgccgtaaacctgcgcggcgatgcgttcaaacgcatcgatcgcctctccggcatgatacaggctgtccgcgcccgctacctcggtgatatcccacggcaggatttctgaaaatggcggggtcccccttcccttgtgtccaggcatatgaaaacgcgcgcggtcctgttcaatatacagccgcatggcgtcatacagcggcgtattcatgagcggcgcagcttctttttgagctgcccgagtttaccgttcagatcgatcgcgcgatcaaccagctttgccttgatgggtttatacgtgtaatcgaattctccggccaattcgtcaagctgaccgttgaagccgcgcttaaactgataaagtcccgccatatgtccgccctccaaatcgcccgaaacgccctggaaatcatacacctcgcagccggtctgaacagcccatttgatcatttcccactgcatcaggtaatttggcatgacatcgcggtggacgttgtccgacgcgccgtacacgtagcagcatttgcccgcgtaattcgtcgttacagcgccgcagacaggcgtcccctgataaaagcccatatacagccgcacatgctctccgagcgcatccagcatccgctcaaaatatgcccgggggcgtacattgaacccgtcgcgcgcgccggttacacgcataatgcgcacaaattcatcgaggtattccggacccaccggtcgcacctgcacgtcatttttaattgcgatgcgcaccttgcgccgcgtcccctgcgtcaggtttgcaaacagctcgtcctccgtgcgcccgttcaggtacaagcgataattgaaacgcgcctgaatgccttcaaagccgtccgggccatagctctgcacaaaccccatatcctttgcgatcctgataaactccgcatcgctcataagaacatccgggtccattttaaacgcatgcgccctatactttttcgcgagcgcgtcgacgccggccttcagatcggccagcacagccctgtcatgcaggtcgcacacaggcccgcgcggcgcgtacagaaacgacgtgccgatcaacggaattttctgcaccagcaccgatacggcgccctgtattgtcccgtcggccgttcgcgacacaaccgcctcatatccccagttgtttttgaccttctgccaattgacgctttgtgtaaagcatccctgcggatgcgccgatacaaacgcttcaaattcgccgtactgctccggcgtcaaaatctccatactgtttcaacctttctgacggcggtctgcctgccccatctttttacgtccgccctgcgggcgggctgggccgggcgtccgtgtccatatcgtcccgcgcatccccgcaaatgatctccaaattgcgcagaagcaccggcgtcccccgccagccatacgccttctccccgcacaggcgggctgcattgtcggcgtgcacaaccggctcgggatgctcgtaaaacgcgggcacacggcttttctgagccagacggttcaccggacacgcgtctgtacaccggtcgcagccccatacgaaaccgccgctgcggatctgggcgcgctcccagccggtcagcgccccctttttttgcgtgatgtgcgagcggcaaagcgcacggtcaaagccgtccgggcgcagcgcacccgtcggacaggccgcgatacagcggccgcagcgcgtacagagcggcgcggcgcgccgggacggctcaagcgccgccgtcgttacaatttcgcctataaagcacctgcttgcatacgtccggttgagaagctggccgttcatgccgatatctccaagcccggccagacaggcggcccgaacctccgccaccggggacgcatcgacaaacggtacaaactgctcgtccgcatacagcgcgcgaagcttgtccgcggccgtttctagcactgcgcgcacaatggtgtgataatcgtcaacaattgcataataggatatattgcgattcggaaaatcacctatataatatccaaacagaacgacaatcacgctgcgcgccccctgcgggatacgcgcttttgaacgcacgggaagcagcggcagcgcgtcgtgaaagcggcagacaccccattcgtcgaacgccataccgcgcatgagcgtttcaagccggctgttcatgagggctgttcaagatcaaactttcgcatcagttcacgcaccacggtgtttgtacaaacgacaagcaggcggtcgcccgaaagcacctgcgcgttgccgcgcgggataatcaaacggccgtcgcgtgaaatggatacgacaaccgattcctccggcaggtccagttcggaaaggcgcgcgccgctgcgccggtaatccggcggaatctgaagctcggaaagcgacgcctccccgcggttgagcggcatgagctgccggatagcggccgcgtccacctcgcgctctaacaggcgcgcgatattgtccgtcgcggaaatcggtatatcaacgccaagctgtttcatgaccgcggcgtttttggggttgttgatgcgcgccaccgtgcgctggatgtggaaaagctgctttgcaagctggcaagcgaccagattgtcctggtcgcgtccggtgactgcaatcagcgcgtccgcatcctttgcgccggcgctttccaacacatcaagcgtgctgccgtcgccgcagatcaccgcgacgtccagatcgtcagcgatccgcgtgcacagagcgcggtctttttcaatgatgtgcggcctgtgtccatgctccagcagcgtcttagacagataatagcccaccttgccgccgcccacaacaatgatctgcattcaaagccacgcctccctgtcaatcgattaccctcgcgtacagcagccggtcgttcggtccaaccggctgccgcgagccagcatacgccaatgtgagattgccgtcctcatgcagcagcccaaacaggacatgatgcgcgtcgtcggcgccgcaaagcgccccaagcgtcatacccacctgtttggcgtccggctgcctggtgtcaaaggagacggttgctgaatcaagatatacatttttgatctggtcccggcccgttagcatcgcgtagatcgcgtcaaccgacaggtttgtcgggcagactgtcggcagtccaaactgtgagaacacatcgccgcgcctgggatcaaaaacgcgcgcaagcacgcgcggcacatggaatacctcgcgcgcaagctggcagaccatcacatttgtattgtcgtcctctgtgaccgcggccaacgcgtcgcacgcctcaatacctcctctgcgcagcaccgtctgatcgatcggcacacccgccacggtatagcccctgaaatcgtcggacaggcgttcaaagctcgccgggtccggatcgatgacagcagtatcgtgccccatgcttgataaaatatttgaaagctgcgaaccaaccttgccgcagcccacaacaagtatattcatctggatcgctccttgtaaatagccctatgcggggccgctttgccaacagacaaagtatacaccatttcaccggcgttgcataggggaaaatggcgctctctgcgtaaacggttgaaaatccgcctctgttggagtacaataggatttgaaagcgtccggccccaccgctggatcaaacgcgcgggcggcgggagcgtaaaagtcttatgaaatccgtgtgcgcggcgttgaaatggaggaaaaccgatatgagcaaactgattgatgccaaaggaaaaaactgcccaattccggtcgttatggccaaaaaggaaattgacggcggcctgtccgcctttaccattgaggtagacaacgcgaccgctgttgaaaaccttcagcggctggcggatagtcaggggttccggaccactgtgcaaagcagcggcggtatcttttccatcgattttaccaaggctccgtgcgagccgtgcgccgcggccaacgcggtgatcagtcagggggcgccttcggggaagtggtctgtatttgtcggccgcgagatcatcggcgacggcgacccggagcttggcgcgtcgcttatgaagatgtttttttacacgctcacacagtcggacgacctgcctgcctccatcctgtttatgaacggcggcgtaaaacttcccgtgcataacgagcagattgccgggcacctgcgggagctgtcgtccaagggcgtcgagatccttgtctgcggcacctgcctgaatttctaccatcttgccgaacagctccaggttggcacggtcagcaatatgtatgagatcgtcgagcgcatgaagcaggccggcaaggtgatttccctgtgaccggttacggtgtcatcgcctttgaatcagcgcacctggctatgcaggccgaacgccgcctgcgcgacgccttttccatcgtgatgatgcccacgccgcgttccgtcacggcctcctgcggcatttccgttcgtttttccctcgccgatctcgatgccgtcaccgatgcgatgcgctccatcggcccggacggcggctggcagattcattgcatgtgacttggcgtttgaaacggataagccccccgcgccgccgcggggggcttttttatggagcaatccgcctctcacgcctgcggcagcgaaaaattctcgtcgatgcggaaggtcgcggcgacccggcgcgcgatatcgtcgacgggcggcgtcatcccctcgccaaaatcggttgcgtaaacaatgaccgggaaacgcagccccatgagaaaatagaccgtttgccgcgcggtgcggccatcgtctgcgttgcggtcaaacgaaacgacataagctgtgccggccgcgccgttccagatggaataggccacattttcggggctgcgcggcggcaaatagtctgcttcaatatattcaaagaaactgtcctgaacagcagggtcggcataatcgacgccctcctgcggctcggtcggcatgatctcaacaacaacattcgacggctgcgacgcgatgtccacagacgcatccgtaaagaacatggcggtatacgaacccatgtcgccgtattccttccagccggccggcagttcaaaggtgaacgggccgcttgtaaaggtctgcgtctcccaggaggcagtcggtgcctgagaatcatcgatctcaatcgtagcgcctgcgtcagcgctgccagagccttccggtgcgccggccgcctgcgaagcggcgtccgcagcgcgtgaggaagcggtttcgtccatgcttgaagccgcggcggacggcgccggtacatcctcggccgccgagggcgccgtacctgccccgcaccctgccgtcaaaaacaggcaggcagccatgaaagctatcaacaaacgtttcatttcacattctcctgttcttttttccactctctgtattcatcatatgtcattgtacgatctgtaatagtgccgtccatatgaatttcaatgattcggttggcgatcgtctcaatgaattgatggtcctgcgatgtaaacagcacgattcccggaaaatcggtcaggccgttgttgacggctgtgatcgattccagatcgaggtggtttgtcggctggtcgagcagcagcacattcgcgccggtaagcatcatgcgcgaaagcatacagcgcaccttttcgccgccggacaacaccttaacaggcttatacacgtcgtccccggaaaagagcatccgccccaaaaatccgcgcataaacgtctccgtatcgtcgggcgaatactgcgcgaaccattgcagcatcgtcagctcgctgtcgttaaagaaggcggaattatcctttggaaaatacgcctgcgaggttgtctgtccccacttaaaggagccggcatcaggtttcagctcatccatcagaatgcggaaaagcgctgtctgcccctgttcgttctcgccgacaaacgcgatcttgtcgccgcggttgacacggaacgtcaccccgtcgagcaccttgacgccgtcaatcgtcatggtgattccgtccgtttcaaggatctccttacccggctcgcggtcgggtttgaaggcgacccacgggtaccgccgagacgaaaccggcatttcgtcgaccgtcagcttctcaagcagcttgcggcgtgatgttgcctgtttcgattttgatttgttcgccgaaaagcgcgcgataaagttttgcagatccttgatctggtcctcgcggcgtttgctttgatccttcataatctgctgcatcagcttggacgactcataccagaaatcataattgccgacatacatgcgcacctgattgaaatcgatgtctacgatgtgcgtgcagatggtatttaagaaatggcggtcgtgcgacacgacgatcaaggtccccggaaaatcaagcaggaaatcctcaagccagtcgatcgatttgatgtcgaggttgttcgtcggttcgtcgagcagcaggatatccggctggccaaacaatgcctgtgccaacaaaacctttaccttgtcgccgcctttgagttcgcccatgggcgtgccgtacagctcaggcgcaatgcccaacccctgcaaaatgcgccccgagtcgctttccgcgtcccacccgttcatttcggcaaattcgccttccagctcggcggcgcgcgcgccatcctcatcgttaaaatcaggcttttcataaagcgcgtctttttccttcatcacctcatacaggcgcggattgcccatgatcaccgtatcaatgaccggatattcgtcatattgaaactgatcctgcttgagcaccgacatacggcactttttcggaatggaaatttcgccggtggtcggttcaagctccccggagagaatttttaaaaaagttgattttcctgcgccgttggctccgatgatgccatagcagttgcccggcataaactttaaatccgcgtttgcgaacagttttgtgcctccaaacatcaggcttacatttgtgactgttatcatttgcagctcctgttaaattaattaaaattttattctgactttcgtgcaggataaagtataccatgctttgacagcacacgcaatgcacagaaagcttataattgccggctgcgcacaattttccaaaaataaataccaattgcaaagaggattagaacggaaatccactgcgatgttgagaagaacaggaaatggccgcgcacggcgtcgccgcgccaaaactccagcagaaaacggacacaggtataaagcgccgcatagagaagcaatgcgccgccagtcggctgcctgccgctaagacggcgctcacgcaaaagtaaaaccatgcagatcgcaagattacaaaccgcctccgtgagctgaaccggaaacaatgttacgccgttgggtgcggccagcgagtgtgtatatacgacgccccagggcgcttcgattccccagcagcagccagccagaaagcacccaatgcgcccaaacacatggaacaacggcagcgcgggcgcataaaagtccgccgcagcccgcaggctgattcgataacggcagcaataaacggccgcagccaagaacccgccaatcaagccgccgtaaaagacataaccgccagaaaaaagcagttctatcgtccgataggaccaatcgatttctgacgcgtgccgcagcagctccggagcaattgtaatcagataaagcgtctttgcgccgatcatcgcgccgatcactccgaacagtacaatatgcagcgtatcgtccgccgcaatattgaaacgtctgcgcctggcatataaaagaatgcaggaggcaagcagtccgagcatacacatcagccaataagacggaatcgaatattgataaatttttataaatggcatcatttcatattccctcaatggaaaaacaggccgcaaatgcggcctgtttttgaatagttcccttatcgcaaatgaaaccgcgaacccgacaggcaaatccacttcatacgcctgccatgaaccgatcatagaaaggattttaactgattgcggcgcctatggtggaagcaaacgcgccgacacacaatacacaagcaatcagccaaagcgtagaaagaacaaggccgataattgaacaaatcatgccagccgtagccaatccgcgtccctgatcaggggcaagctccttacgcgctcccacagcaaaaacaatgccaatgatgcttaaaatcattgcgagcagcgtaccttcgccaaaccagactagaataagagaaaggatgccaagcaccagagaggcgatccctttgctcttagctgaattgttttccaacatcttcacccctcaaacaaattatggttatgataacataatttatatgaggtgtcaacaaattcccatcgctttcgacactgcatataagaaaaaagacctcgctgttagcgaagtcttttgtgctggcaaagacctatctttccaggcagtcacccgccaagtattgtcggcacaactgagcttaacttctgtgttcgggatgggaacaggtgggacctcagcgtaataaataccagctattgaaacgacatatttcaccgacggaagtttcctcccgtatcgcctgccgcaaggctctgtatatcatcctccgcccataggcggtcatgacctctggtgacccgtgcgggaatcgaacccgcgttaccggcgtgagaggccggtgtcttaaccgcttgaccaacgggccgtctcctgcgtcccctcaaaaggttccccttcctccggtccgctctttccaacctctcccggccggaacctctatcgtgagtgccccaaggcacagcatcttctggtgcgccatcagggactcgaacccgggacccgctgattaagagtcagctgctctaccaactgagctaatggcgcatgtctttccacgcaccctcaaaatcgaacaatgaaacttccctgctttcgaaaaccaaccttcgcctggtcaagccctcgaccgattagtaccgccttgctgcacgcctcacgacgcttccacatgcggcctatcaaccttgtagtcttcaaggggtcttacctgattactcagtggcatatcttatcttgaggtcggcttcacgcttagatgccttcagcgtttatccgatccgtacttagctgcccagctgtgccgttggcacgacaactggtgcaccagaggtacgtccatcccggtcctctcgtactagggacagctcctctcaaatatcctgcgcccacgacagatagggaccgaactgtctcacgacgttctgaacccagctcgcgtaccgctttaattggcgaacagccaaacccttgggaccgaattcagccccaggatgcgatgagccgacatcgaggtgccaaacctccccgacgatgtggactcttgggggagatcagcctgttatccccagggtagcttttatccgttgagcgatggcatttccactcacataccaccggatcactaactccaactttcgttactgctcgaactgtcgctctcgcagttaggctggcttgtgcgtttacactctctggcatggtttccgtccatgctgagccaacctttgagcgcctccgttacctttttggaggcgaccgccccagtcaaactgcccgcctaacactgtcccccgaccggattcacggccgcaggttagaatttcagcacctcaagagtggtatcccaacggcggctccagcaacactggcgtgctgccttctctgcctcccacctatcctgtacatgaaataccgaaatccaatattaagctgcagtaaagctccatggggtctttccgtcttgtcgcgggtaaccggcatcttcaccggtactacaatttcgccgggcgggctgttgagacagtgtccagatcgttacaccattcgtgcgggtcagaacttacctgacaaggaatttcgctaccttaggaccgttatagttacggccgccgtttaccggggcttcaattcagagctctcactcctcctcttaaccttccggcaccgggcaggtgtcaccccatatacgtcatctttcgatttagcatagagctgtgtttttgctaaacagtcgcctggacctattctctgcggctccctttcaggagcaccccttttccctaagttacggggtcaacttgccgagttccttaacaacccttctcccgttggccttagaattctcttcctgtctacctgtgtcggtttgcggtacgggtgcctcagatatccacagagcttttctcgcctgccgccaagtatgcttccctactatatttcagtccctttcgcccggggctaccaacgcccgggtcataccctttgacagtgtccctctgcttaaatcctccggcagctacggaatctctaccgtatgtgcatcggctacgccttccggcctcaccttagctcccggcttacccggagcggacgaaccttcctccggaaaccttagactttcggccaatatgattctcacatatttctcgctactcattccggcattctcactcgtatacagtccacatgcgctttcgctcatacttcaccccgtatacgacgctcccctaccattccttgcggaatcccaagcttcggttacacgtttagccccgttgaattttcggcgcagagtcactcgaccagtgagctattacgcactcttttaatgagtggctgcttctaagccaacatcctggttgtctgtgcaactccacatccttttccacttaacgtgtatttgggaccttagctgtgggtctgggctttttccctctcgaccacgagacttatctcacgtagtctgactgctgtacatcaattatccggcattcagagtttgatagggttcagtaacctctcggcccctagcccattcagtgctttacctccggtaatctaatacaacgctagccctaaagctatttcggggagaaccagctatctccgggttcgattggaatttctccgctatccacacctcatccgccgccttttcaacggaggtcggttcggtcctccatgggattttactcccacttcaacctggacatggataggtcacccggtttcgggccctatgcatgcaacttcacgccctattcagactcggtttcccttcggctccacgccttaagcgcttaaccttgctgcatacatacgctcgccggaccattctacaaaaggtaccatatcacactttgacgtgctctatgtgcttgtaggctcagggtttcaggtgctatttcactcccctcccggggtgcttttcacctttccttcacagtactattctctatcggtcactggggagtatttaggcttggagggtggtccccccggcttcccacggggtttcacgtgtcccgcggtactctggatcctgccggctgtctctgtctttcgcttacgcgactctcacgctctccggtctgccttcccatacagttcagctagacttcaacataccttatgcagtccgcaaccccgcacacattgctgcatgcggtttggcctcttccgctttcgctcgccactacttacggaatctcggttgatttctcttcctcgccctacttagatgtttcagttcaggcggttcccctgacatacctatggattcagtatgccatgacggatcgttacatccgccggattgctccattcagatatccacggatcaaggcttatttgcagctccccgtggcttttcgcagcttatcacgtctttcgtcggctcccagtgccaaggcattcaccctgtgccctttgtagcttgaccatgcttgaatcttggttctctttcggctttattgcagtgcttatacccttgtttcatgatatttgcattacataaaactttgttgcagatttgtttcattgttcaattttcaaggtgcgttaccaaagccttccggctttgttggtggagatgaggaggatcgaactcctgaccccctgcgtgcaaggcaggtgctctcccagctgagctacacccccatattgacgcatgaaagcttcttttcccctttcggggtccagcgccttcaaaaatgaacaacgagctttcctgtccctgtctgaccagagtccgccggctctccgccggcttcgctccttagaaaggaggtgatccagccgcaccttccgatacggctaccttgttacgacttcaccccagtcatcaatcccaccttcgacagcgccccccttgcggttaggctactggcttcgggtgttaccgactcccatggtgtgacgggcggtgtgtacaaggcccgggaacgtattcaccgcggcatgctgatccgcgattactagcaattccgacttcatgcaggcgggttgcagcctgcaatctgaactgagacactttttcgggattcgcttcacctcgcggtgtcgccgccctctgttttagtgccattgtagtacgtgtgtagcccaggtcataaggggcatgatgatttgacgtcatccccaccttcctccgttttgtcaacggcagtctcattagagtgctcttgcgtagcaactaataataagggttgcgctcgttgcgggacttaacccaacatctcacgacacgagctgacgacaaccatgcaccacctgtctggatgccccgaagggcttcacctatctctaggctatgcatccgatgtcaagacctggtaaggttcttcgcgttgcttcgaattaaaccacatactccactgcttgtgcgggcccccgtcaattcctttgagtttcaaccttgcggccgtactccccaggtggattacttattgtgttaactgcggcacggaaggggtcagtccccccacacctagtaatcatcgtttacggcgtggactaccagggtatctaatcctgtttgctccccacgctttcgagcctcagcgtcagttaaagcccagcaggccgccttcgccactggtgttcctcctaatatctacgcatttcaccgctacactaggaattccgcctgcctctacttcactcaagaacggcagtttagaacgcagccaccggttgagccgatggatttaacattctacttgccatcccgcctacgctccctttacacccagtaattccggacaacgcttgctccctacgtattaccgcggctgctggcacgtagttagccggagcttcctctttgggtaccgtcattttcttccccaaagacagaggtttacaatccgaagaccgtcttccctcacgcggcgtcgctgcatcaggctttcgcccattgtgcaatatcccccactgctgcctcccgtaggagtctgggccgtgtctcagtcccaatgtggccgttcaacctctcagtccggctaccgatcgtcgctttggtgggccgttaccccgccaactggctaatcggacgcgagcccatctttcagcggattgctcctttggttgcaggggcatgtgcccccgcaacatcatgcggtattagcagccgtttccggctgttatccccctctgaaaggcaggttgctcacgtgttactcacccgtccgccactaagcttacattcatccatccgaaaacttcaaaacgtaagctccgttcgacttgcatgtgttaggcgcgccgccagcgttcgtcctgagccaggatcaaactctttgatattggtattaaaaactctcgcgagcttccaatctttaatcaaagacgatccagcttcgtttcctttgctggtttcgcttgtacgtccgtttcttcaacggatgcactcaatttcgtttccagggtccttagcttccccttccggactttctcaagcccttccggtttcacttcggttctttccttctcgttgttcatttttcaaggtgctgtgcgctgtcgtttgatcggcgtttgtgttgttcgcacgagacagctttgttataataccacactctgccatgcttgtcaactactttttagcatttttttaaaaaaagtcgaaatttcttggaaagctacattttacgcggtatttacatatgtataaagacggcgtcaccgcacatactgcaactatcaggccactcaaaggaggcattttcatgtccaaacaaagcggttatatcccgcgtgctgtcattgtggtccgcacggtatcgcttgcctttgcgctgctgctgctcggcgcgatgattctttatatggcgcgcatcggcggtcaaacggaaagcgtgctttccaagactggctcgcgcggcaatgaggtgcgccaaattcagcagcgtctgaaaaactggggctattatacaggcgaagtggatggaatcttcggtgtagaaacgaaaaaggcagttatgtcgtttcagcgcaaaaacggactgacagttgacggaatcgccggcaacgctaccctaaaagcaatggggattcaatcctcgcagcagacaggcggcagcggcggttattccagcagcgatatcgccctgcttgcaaacatcatttcagcggaggcgcgcggcgaaccatttgagggacaggtcgctgtgggggcggtcgtgctcaaccgtgtggagcatccctccttccccgacacgctttcgggcgttgtctatcaaccaggcgcattcaccgcgatcaccgacggccagatcaacgaagcggtcgcagaatcagccaaaaaagcggctcgcgaagctttggccggctccgatccttcgggcggcgcgctctattattacaatcccgacaagacgtcaaacaaatggattcggacacgtccggtgatcaaacgcattggcgctcatctcttttgcagctagaagctgttcccatcagccttccaaaatacaggcgcccggtcaggtttttacgatctgtccgggcgctaaaatggtataattgattatagtctatactattagtttaatattctgcaaaaatactctgttttttccctgtgttttcctatataatagaggatataccattaaaaccgatgtggtagaaaggcggccgtttgtgacattaaaaaaacctgacctgcatatcctgaccgtttggcggctgcggcttttggcggccgcgctcgtgccctcgtttttgaccgcatggttttcgccccgcgtcaattggctgtggtggctttttacggctgcctggatgtgcgcctttctgtacttttacatattctattatccgataaaataccgcaagctggcttatggcacgaacgcgcattgcctgcttgtgtactgcggcgtcatttatacgcgtgtgaaagccgttccatttacaagcatccagtatacctctgtcttttcaaccccgttggagcgcctgttcggcgtcacttccctattcgtctacgcggctggaggccgtgtctacattccgggtctggccccgcaggacgcgcgggagctgcagacgcttctgactccgggccgcccgcacagcgccgcccaggaaggaggagccggtgatgtctgatgttcgcgcgcgcgctatccatgcgcaccctttttccattctcacctttttatatcgattcctgtttcttctgattatccccttggcgcgcggctttatcagcgcgctgacaggcgatatcttttcatgggtgcgcggcgcctggtttgatattctgattgtagccctgattattattctggcctaccaaaagtgggagcattttcaataccatatggatattaatggcgtatatattgcaacgggtatattttttcgcagtgaattttacatccctcaggaccgtatttcaaccctttctgtaatacgtcccttttggctgcgcccctttcgcattgcccgtatacgcatcgataccattgcaggcgatccgcgcagtcccgacgccgccttttatgtctggtcgcgtgaagccgaccgcatttcttcgctgcgggccgctcccccggccatggattcggacggcgcccccgcgcaggaccggccgcacctctatgagcttgtgctgctttcgcttttaacctctaattccttcatcggcattgttttcatcgcaacatttttttcacatatggggcaaattctcggcgaggagctgtccggtatcctggttacaaccttcgaggagctgtcccgccggatcgcctttggtcttccgcctatcttcgcgggcgccgcgcttttgttgttgtgcggatggcttgtcgccttctgtatcagcctgctccaggtcaaaaacctgtttgtctgccgctcggaaaacaccctccatgtcagcggcggcgtgctcgtccaaaaggaatattctctgcggcgcgacgacgtgagctttatcgatatccgccaaagcctgacaacgcgccttctgcgtctatattccgtctatatcaacgcgatcggtttcgccaaggacaaaaaatccgatatcgcggctgtcatccctttctcctccaaaaagcgcacgcaaaagcgcctggccttgctgctcccggaataccgcctttcgcagcgtacactcaagccaaatggcggcgcaatctttaaatttatcatcgaaccgctctggccctgccttctgatccctgctggtacgattgccgcctgctggcttctgccaagctgggtggaaatcattcgttttgcaggctttatgctctgtctgccggccttttggtttttgggcgtcaggctgctcgatttcgcttcatccggcgtctcatgctgcgaaaattattatacattacgttattcaaagctctatcatttacacacagtagtcttttcttatgataaaatttcgctgatcaacattcgtcaaagcattctccagcggggcgatgacaaatgtgatcttgtcatatcaacgcgtgcggagggacatatgcgccaccatatccgcaaccttgaccgttccgccagccttgaaatcttccgccttccggattttctgattgtcatgaaaaaaaagcgtgcgcaaaaatcgtgatttgcgctcccctcccccgcatttcaaacgcccgcgctgccttttggcagcgcgggcgtttacgtttcagcatcgctgttcctgtttcaacaccctttcgcgtgtctgttcatccaggagcgcgcgcagattccggagcagcgggtcgtattcaaaatattttttaccatactccaaattgaaggcataatcaaattcaggcggattggcgccctggttatgctgcaatattgtctcggccttatccagcgccttcaccaaacgcgcctccggcgtttcgcaggcgttgtactcctcccaaagcgcgcacacttcccgtctggctgtcttcggcaggagcgccgctgcccgttcgacagccgcgcgttcctgccgctccttttcatcctgatccggctgcaaagccgcagagatatccccctcgtacacctcgcccagatcgtgcaccaggcagagcatcagcacccgccgggcgtcaagtccaggatacgcgggcagcagcagcccggccagcagcgccagcctccaggaatgctctgctgtactttcacgccggcctgtacttgtccaagccgtgcgcgtcatgcatttgaggccttcggcctcctggataaaatggatataattgttcaagctgtccattgatactcctcataaactgttttatttattccttaacctccgtaattcctattatattttaccgtatctgtcttgtaaagcttccatatattaaaacaaaccgctccaggcttcgtgacccggagcggcttgtcaacactgtataaaaagcggttatactttttctatatgatctaaagcatatttttgagcaagcgtttgaagtttgctttccaattgagatatacgaattgaaagacggaaaatttttaagatcaagataaaaataattgccaggtacacgaaatttaccggcgatgcaatgccggtcaatttagctccatactctacgatccccggaaatatacttataaaaatcagaaatccggaaaataaaatccaaaatatagaatcttctattttgacttgtgatttttgtattcgttttaaaatccatccacagtttagaatagaaactatgattaatattattcgcagcactatagacacttcaagtcacttcctcactcggaaaaattggataaacaaaatagaaattaacatattcatcatatatcggatagaacgcgccatatttaaatagctttctccagctatcctttcatccatggatacttgaacttcctgcactctggccttgttcctgagcaggtatgcaattgtatccggttccggcccgtaatttaaacgggtactgaactctgtaatcagcttgcgattaaacatccgcatccctgatgtaggatctgtgagctgcttccctgttgtaatacggattgcaaatgaaatcaggctgcttcccaacatgcgcaatgtatgcggttttttttgcgttaaaaagcgagagccaatgacaatatccattttttgttcctgcatgacctcagccatttcagctatatattcagaacggtgctgcccgtctccgtcaaattggattgcacaatcataaccatatttttgggcatagcgaagacccgcttgaaaagccccgctcaatcccaaattgattggcaagtcaagatatgtaaaatgatgttctcggcaaatttcaactgtatggtcggttgagcagtcatttacaaccagatactccgcccctggaaattgcttttttagcgtttcaacaacacgttcaatattttccgcttcattataagccggaataacgatcagaattttcatccttatcccccaattacacaggcaatgttttaaaatttaaaatccacatgcagcaaccgccgcacaaaccgatataaaaataagaataagctgaaacaatgaaatttgtacaacagtttacatatatagagcgcatatcccttgaccccatgccggaccagagaaggcagccgcaaaaagcggcaagtgcgcagtccgtcaaactgcgtataaagataccgccttgtccagcgcaagtgttcacctatttgaaccgatggattgtcatacgcacgcgccgccatcgaaatccctatatggataaacgccaaaagcgccaaattctcacgcagtaccggttcgcgctgtgcttgatacagttgtgcaagctcgtccgcaaacgccctgatcgtttccggctgcgtattggagattaccgaaccgccgcgcacgccgtaatggattaacacgtcctgcacgccggcaaccgataccgcttttgcgtacagagcctgaaggaaggatacatcctcccccaccttgaaatcaggtatacgcgtattgccaattaaatctgtacggatcagcttattccagagagagccattaatgaaacataaactgtcatcctgcggcggcaaatgcagcaggatgggaaatgatgtcatttccgtacaaagcacgcgtcctgtttcttcatcgatccggtcgtagccgcagagcgtaatatcagcgttggtacgcagtgcggcagtatgcagcttttccaggaaatcaggctccaaatgatcgtctccgtctaaaaatataacgaagcggccgtcgatgaatccgctgtccatcgctgcgttacgcgtccgtgcaggactgcccagatttttttcccgctcaatcaggcgcagccttcccggaaagttcgactgataatcccgtatcatcaaaaccgtgcggtctttggaacaatcatcaacaatcaggatattgaaatcctgaaagctttgtccaaacaattcatccaaacaacccgctatatatgattcaagattgtacgaggtaataacaactgttatttcaggcacaaaactccctcctcaaaacagcgtaaatcctcgcggtataacacagcgcaagtattgcatgaaggataacgaaagaaagtaccgcacctataagcccagcgctgtggacacatacggctgtcgtcggtacggcgaccacagttatacacaaataaattttcataatccatttctgtcgccggaggataacgaatatataataatacaactgacagacggcaaagatgcctcctcccaacaccaccagaatcagatggattcgcaatgcggaaatatccttttgatacagcagggacagcaccgggattcccatagcgtaagcacccgcacaacacacacacgtcaacagggcaatcagaactatttgacgcagaagcagtatgccgaaagtccggatctgtctctccgacaggagtttggaataccggttgagcaaaggcttgaacaaaaactggctgcacaaattgataacctgtgccggcataaaaatcatgttgtaataaccctgggccaaatcattcatcatcagttcgataccatatttggaagcgttgattacgatattcatcaataatagactgacaaatagcggaaagcattccatcagaaggttttgcacctgtcctgacgctctgtcgcatggttgcgctgaaataaaccggggcgcgacccatacggcataatagattgtaaggaacagattggccaaaatctgtacggacagcgcgacaataatgctgcgtgtcacccacaaaatgatgcaaaacagcagcaacggccagagagtccgatagaacaatgccgagccggagagatcaagacggtttttctggaaaaaaagactctgatataattccccgatcacattcagcagcatcagggctgtaagaaagacggtatagcttgcttttgcaccggtgaaatgaaatccccatatggcgattgcgcatccacatgccatcaacaaacaggaaaaccgtctggcatgaatatagtcagaaaacctgtatttctccccatagtccgtcatctgaaaatgcgggacgccaaacaggccgacgatgtacaatatttgcgccgtcgtgaaggcgatcccaaaatatcccgcctgttccactgtcccaacacggctgaccagcgccagcatgatgaagctgttggctccatacatgaggctgccaagcgaattccaaataactccttttttgttcatatggcttccaaatcagatcgaattttatttaggcattccagcgcttttattcgtgcggcatctgccttcgttttaagcttgttttgaatttccgtataatgatctataacattttgtgttatgttggcaaccttttccggagaggcttgcccgattgtacaggcatatgcctccatatcgagaaaatgcaacacctgttgaactttttcatcataaattaaagaaataaatggggttgcgcgtcgcgctgcaaatataatagaatgcatacgtattccgaataataaataactgtttgctataatttccgccatttcaacacaaccgtaatttggtggaataataatacaatcacaatcttccaataaatccttcaaagtttccaagagttttatatcataagtgacggtcggtacaaaaaccaattttttattaataatcttataaaattctttaatctcttgcgctagtttttccgtttgcatcttaaaatcaatgtgttttctatcccaaaaattagaagattcaaaccatcccgaaaccgttacacaagcataattccgttcctccaattcaaagcgcgctaataaatcgtttttattgggcgatatatctgttactgcaaatgcagcgtcacatactaaaacggcgttacaaatgcctaagtctttacaaatttttaatccgcgctcatctcttacaaaaacaccatcggccctcttcaaaaagtagcggcttaattgttttcctgtttttgtgcgcagggggccgacgcccatattggcataatatactttctttctcaatattttggccaccatatgccaaaagtacaaaaacggtaaattgtaacgcgttaaatcatgaataaggctcccaccaccatatatgattgcatcagctttcactacgtgaaacagtatagagaaactgtcttttatcatactgaaaacgacgggtaatgatatcccttcattcatacggcagggtatggttttaatggaaagatactccgccatatcttcataagtaccattcgttgcagtaatctgaaaattggatagctgttgtgaaatagattgtaatattgcgtcatctcctcgattaccacatccataggctcctatgattaaacatttcttcatactgctatcgctccacttttatctgatccggatcacaataaacccctatcaaatcgttccaatctatcgatatccctgcttattctctccggcggccaatcccaccaactaagcgcctgcaaaaaatcgatggtctgttgatcaaacctgtattttatcacccgtgcggggactccgcctacaatcgcatatggcggcacatcttttgtaaccatcgccttactgccgattacggccccattgccaatggtaacgccgcccttgatcgttacggaatcccctatccagacgtcatttccaatcagcgttgttttactagttatttccatttacccccgtttcaaatttttggaaattggcgacgccattcccgtcatcctgtagcttgaaaaactatgatacggatgttcattcaatccgactgaaagcccttctgcaatacagcaaaactttccgattcgcacattccgaataaattggttctgcttcaaaaatgaataatcgccgatcgagacattgcttgaaaaaaccggccacccgtataaattgacgcctttgcccagcttgggtttataaacaattcttgataccagcgactgaatccagcgcggcatgcagtaatacaccttataaattaaattgatcatgttttccccatccgtttcactctgaactttatataggccaggccggcttttgttacccgcttaaattccgcccagctcaagttggcaagaaacgttttaaaaacatacgtaaacgagaagtaatagcggctcattaaccgatcccggattttttctatttcctttgcagacgcataaggatagtttacaaggcagtttaaatatccgtcgctgttgagccacttggaataatcctctgtaatcagataaccattctctttggcccatttataaaatcctgttccgggaaatggcacggcctgctgaaaaaacaccatatcgggatatatggactttgcaaattgaaacgtttcttctatcgtatccagtgaatcccctgtcagaccgatcatgaagcatccaaatactttgattttcagctttttcgtattttcagcaaatgcgcgcgattgttccagcttgatcccctttttagtttgatccagcacaccctgatttccagattcaaagccaactacaagaaggcggcaccctgcttctttcatttttttcataacggcatacggcagatccgcccgtgtgttgcatgaccaccgcaatttaagaccgcgccgcagaatttcgtcgcacacctccattacccgttttttatcggcagtgaacgtgtcatcctcaatgaaaatttcacgaatttccggcatttgcttatgaatatactccagctcgtcaactaaattgctgacagaccggcggcgaagctggtgtccccccattgtttcaggataagagcagaaattgcagcggtacgggcatcctcgcgcgctgaaaatctgaatcatcggcttctgcgcgaatgcatagcagtagtcattgacatccaaaaactgctggtaaacctttgataccataggcagctcatccagatcttcctggtactctctgtccttattgtgaattatttcattatcattcctgtacgaaatgcccgcaatctctgccagcgcctttccctgcgcaatctcggggattgtaaaatcatattccccccgaacaaggatatcaatttccggacactcctccatcacctgctgcggcaatgccgtcgcatgggtcccgccgattatgatttttacatttggattcgtctttttgatcgcacggatgaccttataatcctcataacacgtgggcgttgtaatctcggccatgatataatccggcgcaaatttttttacctccgccaatgtttgttctgtattgtagtgacgcacaatacaatcgaccaagttgacctccaagccgcatttttggctcatccctgccgcatatgccagccaatacggataatacaacgtatcggatttcgttttttccggccagcggctggcccggctgatatcaaatttatacggtaaatttaaaaataatacgttcattttgtctccttcaattattcacttcttctatagaccagtttttaaacaagccgcttcaccgtaatatgatactgtaaaaataatgatggcagctgtttaaaaattctaattgtttaactatgcaaccatatatttacttatacaacattcccatattccgctaaatagaattccggcacttccaagtgtgactataaaattgtatttatatctttctatgacgttctttatttttcctgttcccaagaatataaaggctgggagtatggctggcagtaaataacgtccctgtgcgccatttattacttcggatcttactggagtaaaagatatatacactgaagttgaggcaaggcttaccgcagccaaaactgccaggtatacaaaaattcttttccatttaccatcgacaataataatatcagtctcgttgcggtctgtaaaaattaccgctgtgagcaaggctattgtctctaagtggcattttacatatcccatatatgccatagacatcatatagttctgactaaatcccaatgaaaaataagaaaataaatgttttatcaatataaacgcatatgaaattggatgacctataataaattttatttgttcaatagcattaacatcagtgccacctcttacgtcactgaacgaagctggacttgccacgaaccccagtagaccaataagtgctaatacaaaaatcgctaaaaatatcattccataaaatctatttcgcttatttggggaaacgaatttttctttaggcattaataaaaaaataattcctaatacaccataaatgactttatgaatatatgccaatacaaaaatactcagcattactattgtttttcctgttgtcatacttcgctctttacatttccattctttaaaaaagattgccagccaaagcatggtcaatgcagtaatccatgtgtcataggagtaattacatgctaaaaatatattcgtaggcaataatgcataaactgtcatgatcattttcccaacaggcgtttttttaatggaaaaatagacaatgatcgtgtaaaacagcaagctggaaatgcgtcccattaccagtatcagcgtatatcttaaatggagcaatcgtcctataaataatccaattgctgcaggcaaataagttattcctgtgttgatacgatatggcctcggtattttctcagatataacgccttcggaatacatttgttccagtttctgtgcttgaacttgaatagattcttcatcgtaaacaggaggaaggcttatattccccaatgaaagctctgctcgagttatctttggggtgccaaaataagacatgtgcatcgaacgaacaaaatgtgcctcgtcatcccaggacacacctgttgttcttggcaatgtaatacatagtaccagacctgctgccaaagaaactattgcaaaaattgtttccggccttgaatatatttctttccaataaaatacaccgagaaataccagacctaaaattgctcctataaatatcaggcgatataatccgtatgtcccgctttgcctcataaagggttccgtcatagccgcaatagtaaaagcaagcgcccaaacgagtaaaaatttataaactttcttttcaaaaaaaaactttttaaaccttgcaatgggtctttgcatattggtcattttccgcttctttagaaaacgatcataaagtatccaacccacaaaaataattaagaatataactgacactcgaattgaactaaatgttttatttaaagtcgaacgttcaagcggttgtgcactaaaccggatatcttttaattggaaatcagaattgatatcgattctgataaaaggatactctgcgtatgggattattccaactaaaatattctcgtctacatggaaattagtagcattttgttcgttcaattcgccatttttatctgggtaataaattcgggcatttatattctctgcgtcatctaactgtatttcaactgattgtatagggatagacaatccgccaatatatatttgcgggtcattattaagcggtataaaatatccatccttatactcgtatccgcttacttcaattttataatctccagatagtgcggaagtgccatccttgaacgaatatttgtactgatttggctgagatgaaactattgcgagctcgattaagattgctactataaagcaaatgattaatcgcttggcaatgccattttgttttttcatcttagtgaaaaatcctctctgtctaatgtaagattcggattataataagggtctccagcggccaattcttttgcccatcgggtctgaaaacggcgtacttctccttcaaagcgtttttgtttttccggtgtatcatcatatccccggcttttggattcataatgatacaactccgcatatggcgtccatacaatcaaatagcccgcctgacggattcgcatgcacaaatcgacatcattaaatgcaacctggaatgtctcatccagacctcctacttctttccatacattacgccgaatcatcatacaggcagctgtaacagcggacacattgtgagcgtagatcagccgacccatatatccaaaatcgcagcggtcgaagcccctatgataatggccagccagcgtcagtatgccgatacctatacctgcatgttgaattgtatcatcaaaataatacaattttgctcctaccgcccccacatccgtgcgctgggcaaacatcagcatttcttgaatccaatctgcgctgataacttctgtgtcattgttaagcagcagaatatattctccggttgcaaattttgcaccataattattgattgccgagtaattaaactctccattttttgcttcccatgtaacaattttaatattctccaactgttttaattcttgatagtaatctcgggttgcaatttcaatactgttattttctacaataataatttcccaattcttatatgttgttaatttctgtattgatgttatgcattttctgagatcatctgcatggtcacaatttgcaatgataatagaaattttaggtatcgctttaatcgtgtatttgatgcgatacatggatggaactacagtatcttcaacaaaaccttccaagccgactctggaaagatgctcagtgattgccccttttgcagcttctatcacatatggctttgcttcgatcccttgagcaacagagtctttatgtgcgcgccaaaaataaagtatttctgagatatgaaaaatcttttccgctttttctgtcaatctcaggaccatatcaaaatcctggctgccatcatatttggagttaaacctgccagcctgatccattaactgtcttttaaatacagtgaaatggcagatatagttattcgctcttaacgtatccggagcaaaatcaggtttgaaatgcggacaaaacgcatcttccggtttgtcatgaaacgtattttcatccgtatagataaaatccgcatcctgttcacagatcgcccgcatgacctcaaacagcgccgctggatgaagcagatcgtcatggtcaaacaggccaatgtaatcacccgtcgacatctccagacaggcgtttgtgtttcccgatatccctaaatttttttccagcttcacataatggatacggctgtcttttcggacgtactgcttgcagatctgtccgacattttcatgttgagcatcgcttccatccgccatacacagttcccagtttccataggtctggtccaatacggatcggatcatctcatgcagaaaccgcgccggtgtgttgtaaagaggcaccacaatgctgaatttgatgtctctggcaaactgaacgtgccgttgggcctccagttcttcctttgtgaacaatggttttttcgccagcctcgcaaaattttgccggtgcttgcgccagtcctgaacctttctccatgtattcctcaacccattttttttcaagcttcgcattcccttaccaaataagcgcccataacgggtcttgataaagggacgtttcaccatatcaacaataacgcggaatatccatgttatcttccagaaaaaagcattagatatttcactgtaagcttgctcgctatcggacagctttcgtttcaattcttcccgctgaacaatcgcggcatggtaatgcgttttgtaatgtgcaagttcctcctgcattgcctgcttatctttttccaattgaacaatccgccggcgggatgtctccagctgtgtctgatgctgctcctcctgctgcttcaactgcgcctgctgtacagcctcctgtctggcaacggcagagcggtacgctccttctctgcgggacagttcttcattcagacggttctgctcccgcttagcgtcctcccaatcggcaaacaactgcgccagcatctcggtattttccggatattgcagggggagcacatgggcacgtattgtaagagacgaaaccgctttaccttctaattcaattcgaaaccttggatcctgctccagaaaaatcgtgtatcccaaccattctatcccattttccggaactgcccgcagcgtcccgatatcggagtacacatgcaaatcttctacgatgcaagatttttctgcgggatcaaaacgcaaggccgatacctttggaagacgcacttccatccgtacttgaccatcgcgttcatcacctatatagtgaagcgtctgagcttcgctgaatccttcttcatttcccgcccagtaaagattagcctggaacggtctttttgccgcctgttccagcatatcccggtgaagcccatccattaggcggatattgcgttcataatcctcaatctgccgcagcacatcacttttcttccgatagcaggcagcatgataggtaatgtaggttggccgatagttcaggtcatcataaaaaccattttctgcaaacaaccgggcccaatactcccgctgctggacattcagatgcgttttttctgtaaaatcatcgggagaggaagaaaaaataaccgtatccgccaagctgcacaagttttggatcgcctttttcccagcatctgcatacagatgctccaaaacttcgattgtaaccaccacatcatactgttccggcaatccctcaggcaaagggtccaataaagaacctacggcgcaatacgggcggatgtcttcccttacacaacagatcgcataatcggaaatatcaataccatatgcttcgacgcctctttcccgcagggctgccaccaaatatcccatcgcacatccggcatccaaaacggttctcggcctcaagtcctgaacgatgcgatctgcaatcgcgccaaaaaatatttcccattgttccggttcctcatatgggataggcccgcaatcggtatggtagtattcttgattatatatctcgctcatctgtgtaaatcctccctatcctccctgatatgcatcacacacactttgcgcatctccgcacaacctcatccgtccgtggtccagccacaggacccggtcacacatctcccggatctgctccaggctatgggatacaaacaacacagtcgtgccgccgcccatcaactccagcatcctttttttgctcttttcctgaaaagcggcgtcgcccaccgccaatatttcgtccacgatcaaaatatccggattcactaccgttgcgatggaaaaggccagccgcatcaccataccggaggagtagctgcgcaagggagcctcaataaattcccccaactcagaaaaagcaacgatctcatcatatttgtcctgaaggaatttttccgaatagcccaggatcgcgccgtttaaaaagatgttctcccggcccgacagttcaaagtcaaatccgctccccagctccaacatgggaacaatggtcccgttgacttgcagcgtcccttccgtgggtttcaatattccggagatcaccttcagcagcgtcgatttgccggccccattgtgaccgataattcccaaaacctcgccttttcggacgtcgaaactgacatccttcaaggcccagaattccttatatttgatctcccgcttcaaaaatttgaccacatactccttcatgctttgaatccggtctgtattcatcaaataccgcatggagatattttccgccttgatcataagcttgcctcacagattcaaaataaacttatcctgttttgttttaaaaatgatcgctccgaccacaagcggtacaaaggaaacaaccagacagtaaaggtaggcccttggagcaggggatacgccatcgatcaaaatgcagcggacaaatcggataatgtggtatagcggattgcatttatagagcgtcatatactgctgtgggataatgctctccggataaaagatcggcgtcatatacatccacagcatggaaataacggaccagaggaactgtgtatccctgaaaaacaccatcagcgtggacagcaaaaatcccataccgatgcagaatactagcaggcagctcagtccaaaaggcagcagaaggatggccggacggggtttaacgccgctaataatcatgacaaacaacagaggaatcaaagacagcagcagattaaccgtcgaggacaacactctggaaacaggatagatatacttggggacgtagactttcgtgatcagcgcagcgtttcccgttatagatgtcaaagccaaaccggtcgactcgctgaaaaaattgtaacatacaatgcctgacaacagatatagtgcatagtttggtacatccgaccggaacagagtagaaaacaccacatactgaacggtcatcgtcaggagcggattcaaaaaactccagcacaccccaaggatggaacgcttataacgggtcttaaaatcacgcgctacaagctgcttcaccaagaaaccgtagcgctgaaacatccaatatagacgcaggcccaaaatattcttctgttttttgaccgactggacaagccgcagaaggtaaagcccaagcagcagaccgccgccggccgctaggtaccagtaatattggcccacccagaaatcgtttttcatctggagctggaaatgcaaaatcttcccagtgaccgtcccgttgacctcaagctgcttgtcccgcggcagttccaacgccacctcccccctgcccgccatcatggtgctgcccatccagggggtgattgcattccccggctgaccatcaggcgaagtgagcacgagcgcatattccgctcctttccgtagcagtgccggctcaacaaaagaaatagtccgcacgatgttgtcttcgatatccgccgcaggaaccaccgcctctgccaagatctctccctggacgtcctcgatgctgacctcaagatgagacgtattttcccttgcataggtcgataagagcatagacacagcagacaattcgtcggcttgcgctataaacggctgccgcacattcatgccctgcaccagctcacccactggctcagctgcatgaacagcgtctgtagacaggctttgatatctgagctgatcgccggcaatccaatagaacccgactgccaacacgatataacaggccagcacaatcatgcagcccttctgaaaacgcttcatgttcaagtcgattctccaatttctataaggtaacgtcgcagcgcgttggtccattccggcaagggccggaagccttgcgcggacaacatccgtttgctcaatctggaattcagcggccgtttggcgcgggtaggatactccttcgtcagaatgtggttcacctttacctcttttccggcacaacggaaaatctcctctgcaaactcggcccaggaacagactccctcattggtggcatggtatagcccgaattggtccgtccgtatcatatcgcacagcagcggggccaagtcggcggtataggtagggctgccgatctggtcgcagactacatttaattccgtgttcgatttggacagccggagcatagttttgataaaattatttccgttcgcaccaaatacccatgagatgcgaacgataaaatagtctgtcaacagactctgaacaaccaactcgccggccagcttgcttgctccgtacacattggttggattcaccgcatctgtgacctcgtaaaactgttcccccagtcccggaaacacataatcggtggaaacatacagcatctttgcgccaatggccttacaggaaactgccagatttcgggtcccgtctacattagccgcccaacactgttccgcttcatcctctgccttatccactgcggtgtaagccgcgcagtgaatcacagcatccggacggtcattcccaagagcggcttccaccgcctttctgtcggtaatatccagatcttcaacggaaacaccccaattttcgatccctctccgcgtcaattccttacatacgtcataacccaattgtccgctggctccagtgacaaatactctcatacttacctctttataaaatacgcttctgtctaagcctgatcaaaaacatgaagataaattccggcatccgtgcgaataccaactcgaatagagatgtaaccacactaaaatgccggtatttccaaatttcccaccaggacttccacttacctgaaaaataatctgacctggcccttgtccatatgactgcttgatctattacagctgcaaaattcaaagcgccgtctatattttcctggagccatatcaaccgcttcacatgctgcaaaatctgtttatcataataactgcgtttatcagttatcccctgcatggaaccagtctgattttccccatggatccggtaagaaatggtagggcgcggcagtgacgctatcttcccgcacattgcaaccttcaacgccaaataatggtcatgtaccatatagggacagaaagggacggcggcccgtgcagtatctgcccggataagcatggtgcatccggcgacaaaattgcggatcaacagtttttccgccaagccctcaccgctgtaaaatcgaaagtgtttatatacttgggtaatgctgtctgcggtccgcctgccctgcctgtcaatcacatacatgtccgaacagaccaactgcgcccgctcgcgctctatctctttttgcagcagactcagcttctccggcagccagatatcgtcctgatcacagtaagcgaagtatgccccctcagcctccgcggtcaaccgttcaaaggtgccggtggagccaaggtttttttcgttgcgccaaagttcccaggaaaaagagcggatactctcgctgacacaggcttggatcgcttcaattggtacggtcggtgagcaatcgtcccgaatatagagttttatattgggataggtctggccatccagcgatagcagctgctcccgcagccaatccagccggggctcatagacagccatcaaaatcgcaattttcggggtctcagcgcccggcatacatccgttcataataattctgataatctccgttcacgatttcctcccaccaggaacgattattcagataccactcaattgtccgttggataccgtctgaaaatttagtggcaggcagccaacccaattgctcgtgtatgaaagtcgggtcgatagcatagcgcatatcatgacccttacgatccgtcacataagtgatcagactttccggcttgcccaaaactcggcaaatcaacttcacaatgtcgatattacgcatctcgttgtgaccgccgatgttgtaggtttgtcccgcctgccctcgttccaaaatccggtcaatggcaacacagtgatcctcaacatatagccagtcacgtacattcagcccctggccgtataccggaagcggtttgttcgccaaggcgttggcaatcatcagggggatcagtttttcagggaactggtagggcccataattattggagcagcggctgatcgtgataggcagcccatatgtccggtggtaggcattgcacagcagatcggccgccgccttggatgctgaataggggctggatgtatggagaggggtctgttcggtaaaaaacaaatcggggcggtccagcggcagatccccatatacctcgtcggtagatacctggtgatagcggctgattccatatttccgacaggcatccagcagcacttgcgttcccatcacattggtttttaaaaaaatcgccgggtcttcaatggagcggtccacatggctctccgccgcaaaattcacaacgatatcaggccgctctgcttcaaaaataccatagatagcctcccggccggcgatatcggcccggataaatttaaatttggggtcttccataacaggcgccaacgtggctaaattcccggcgtaggtcaacttgtccacacagagcaaattgtagtcaggatgctttttttgcatataaaaaatgaaattgcttccgataaatccggcgccgccagtaaccaatagcttcattgttcatctgctccttaatacatttcaaagcccgttgcagcatccttcagccaaggcgcgttctgatccttgccgctcaggaccggctcggaaataccccagtcgatcgccaactccggatcgttccagcgaatcccgccgtcggcctctggcgcgtaataattgtccgccttatagaggaactccacctcatccgtaagcgttaaaaagccatgtccaaatccccgtggaatcaaaagctgcttcttattttcagctgacaattccactgccacccaccttttataggcagggctgttgggccgtaaatctacagctacatccaaaactttccccttaacgcaccgtaccaattttgcctgagccttgtctccccgctgaaaatggataccgcgcagcgtccccttgactgtggaacaggagtggttatcctggacaaaatcataaaacagcccggcatcctcaaacacacgcttagaccagctctccataaaaaagccccggtgatctccaaagacttccggctctgccagatacacgccatccagctccgtctttgtaaatttcattgcccacacctctcaaagctcaataaatatattttccagccgccacattgcataggtggaacccatatggagactttccataagcattcgctgcgtcttgaagttgttccgttgtaatccaaccgttgcgaaatgcaatttcctccaaagccgcaatctggatcccttcccgggactcgatcacccggacaaattccgcagcctctgatagagattccaccgtgccagtatccagccaagcataacctcgtcccaaggtaatcacattgagcgttccttcttccagatagaggcggtttaaatctgttatctccaactctccccgcgcggaaggcttcaggtttttggcgcgccggcatacatttttgtcataaaaatacaggccggtcaccgcataattgctccgcggcctgacaggtttttcttcaatggataccgctcgcccttctgtgtcaaactccactacgccaaaacgctctggatcctccacataatatccaaatacagtagcgcccgtctcctgttccactgcatgtctaagatgggcagtcaatccagctccataaaaaatattatcgcccagaatcatagcgcagcgatcgccgcctataaattcttcacccagaataaacgcttgggccagaccatcaggcgagggttgaacctgataagacaaccggattccaaactgctctccaccgcctaaaagccgctgaaaattcggcaggtcagtcggtgttgaaataattaggatatcccgaattccggataacatgagagttgacagcggatagtaaatcatgggcttatcataaataggcaatagttgtttactagtcacttttgtcagtggatatagccgtgtaccagctccaccggccaatataattcctttcatctcatgtctccctttctttttgcatctgaaacttaaatcattgacaggttcctatatccaggttattaacatcctatcagaaaaatcaatgctttataacacctgaatcctttattcttataagcgtgcacgttcccctttattatccagcgttcgtatgaaataccggaacgcgtcccgcgtccgtgcatattgatactgaaccatttcaaaacggcaggctttggagatgctctccattgcgcttatatctgaaaagagcgctgtaagccgcttgccaataacggcgctgctattctctgataaaagccaacctgtttcgccttcccggacgacgtcgggcacgccgcccaccgggctgaccagaggcggtacgccggccgccattgcttccagaagcgcgttgggaaggccctcataattggtgggactgagaaacaaccgccagcgtccataataatcaggcagggatttgtggtcgatccagccaagcattttgatatgtgcctgctctcccaaaaggctgatcagctgcgcgcactccttccgcagcgggccgtctccgacaatttccaaggagtattccggaaagctgcggcgaaactgatgaaaagcctgcacagcctccaaaatacgcttacttgccgccaagcgcccacagatcccaattaccggcgggcgttcagtatatgaaagacccgcgttgaaaaaggcatcctccacataaagatgcaccgtatgcagcccctcgcgctcataatcaattttccaatgatgtgctacagacggcgactccacacaggccgcatcggcatgccgtgccatatattccatcagcaccgcttttaggaagtttactagcgttatatgttccgccttgcggcggctgtttccataaaggaatccaactgtataaagcccggccaaacggcagtaaagaaacggaaggatcattggtccggaaagccagaacaggactaccggcgcatgattccgcaaagcgtgtatgcggcggattgcagcggcttgcatacgtaaatagccccatacggcgcgtaaagaatggtccgtcgtaaactccggcacaagatttgtcaatcgaaagcgatgtgacggcaaatctgcaagagcctgcgccggaaaatttgccgttagaaattctgtttgttcaaagacatcgcagcacagccgcatcattttgtaattcaccgcaaccggcgatgcattattggaaggaacaaagctggaaattaatatggctttttgaactgtcattgtttcgcgcgtacctgctgcttctctcctctgcgcaataattgatcggccgcatcatctgaaagcccctgtgagctttcacgcgtaaaaagcactttgattgtcattaggatgattttaatatcaagccaaagcgaatatccttcaatataggcaagatccattttcagcttatcatacggtgatgtgttatattttccatatacctgggcatagccggttaatccagcctttaccttgagccggaaatcaaattccggcatatcaagtgcatactgttgcgcgatttctttcctttcaggccgcggacccacaatactcatttcaccttttatgatgtttattaattgtggtaactcatctaatcttaacctccgcaaaaatttgccgacagatgttattcttgtatcattctcacttgcaaggcgcggcccgtcgtaccgttccgcatcgacctccatgctgcgaaatttatacagtatgaaaatgcgccctccctctgtcaaacgttcctgccggtataataccggaccgcggtcataacatttgatcgttacagctataattgccataattggagaagttaaaacaagcgcggtcaaagatattgccaaatccaaaattcttttagctgtctgctgcccgaaatcaagtcccctgttgcggcaaagcaacaatggagaatcaaacaaatgaatcgcctctgcaccgcgaataatggtgtcggaaagcttgggcgtcagatagacacgtaccgattgccggaaacagtacttcagaagctcgttgcgtatatccgatttaacatcacaaatcagcaccgcttcatactgcccaatcgcctgacaaatagtttcccagtcctcagcaacagtaaccgctccgcaaatattatatttctccgaacggctgtttatttttgacagcaaacctttcggctgatttccttcatatattaaaagtatccggcgcggcggataaagatgataatataatttttctgaaaaacaagcccatattatcaggacaaatatatctgttattgtcaaaattaacattggcgcaaaattcataaatctgcgtccaattaatccaatttgcaaataattcaaaacatttgtaatcaacatggaaaggatcgcagaataaataacgtcgctccttttaagataaccaatgcgaaatccaccataaatacgcataaatatataaagtgttaaggcataaacagcaattaccagccaatttccttttctaaaaaaaggctgtacaatttcctgcgcataacatgtataccatataattccaaatgttgccgttaaaaaaaccattccggataaagatgttaaaaacagcaccaaacgtttattaggacgcttgatcatatttacttttttcaatccgtgcttcctccatatttgatcgcttgtttttctacatcattgcacacttatacagtctattgtttagattataattgatccgattcttaaagtcaagaaggggcaaattgctccattttacatttctcttaaaacacaaaaaagcctccgcttctattgaaccggaggcttttgcggcaattgcccaaaattactgtaggctgggcgtgggcggtaacttttggaaaagaaaaagcctggagccagatggcgctccaagcttttgcctgatggtgacctgtacgggattcgaacccgtgaacccgccgtgaaagggcggtgtcttaaccacttgacgaacaggccggaaacattgggcctcacgcagcagtgaggcccgactggtagcggtaactggattcgaaccggtgacacttcgggtatgaaccgaatgctctagccaactgagctataccgccattttctgctcccttattatatgagcgagcgtactaaattataccgtagaatctttattttgtcaatagctttgcagcttttctgtaaaatttatttccgcttcaaaacagcgtccgccgccagccataccgcccacataatatgcactttgcgaaatctgtgcggtatcaagctcgatcacctgtcccgcgagcgcctctttttgatacataataccgaactttttaatttcacgttcaacaagccaatccaacggcagcgtatcgcagacaatatccgcataaaccgcattgttgacatgactgttcgaatcaagatcgctgtactttacctggcgcatatggcgcacgcccgctgcatttggttttttgatccggtacgcggtgatatactccccgtcgtttggaaacatctcaagtccatagatatcaaacgccgcaggccgcaggatgcggtgtgtgcgcggatcggccagaatccaggaaatgcttgtctcgacaagccgttccccttgttcggtatcaaagtaggtgtcccggataaactgcgcgcccttaggcacgcgcgggacagtgaccaggcgcaggcgttcagcataaaccggccgccgcttgattgtaatcagcatcttattgacaagaaacaccatgccgtcctgctgcatccgttcataggtaatcccttcccgcgcgatatgatcgcttcccatctgctgcgtatggcgcataatattcgataagctcatacgatgcgttagatcgcattcaggctcggttacttctatccatttttcaaactcacggatcaagcgatacgccgcctctcatcattcctggaggccaggtccgccttttcaggcagacccggcttttatttcacatatggcttgctttatttttccgcactgacacatggcatccttttacggccggatcgcgtccttaccgcccatatacatgcgcagcggttgcggaatgcgtacagatccatcgtcgttcaggttgttctccaaaaacgcgatcaacatacgcggcggcgcaacaaccgtgttgtttagcgtatgcgcaaagtagttgcctctttctttattcctgacgcggatacccaggcgccgcgcctgggcgtcgccaagatttgaacagcttccaacctcaaaatactttttctgacgcggcgaccaagcctctacatcgacgcttttgactttcaaatcagccaaatcaccggaacagcattcaagcgtgcgcaccgggatatcaagcgagcggaagaagtcaaccgtatttttccaaagcttgtcgtaccaagcggcgctgtcctcgggcttgcagacgacaatcatctcctgcttttcaaactggtggatgcggtagacgccgcgttcttcgataccatgcgcgccgacctccttgcggaaacacggcgaatagcttgtaagtgtctgcgggagcttgtcctcatcaagcatagtatcgataaatttgccgatcattgaatgctcgcttgtgccgatcagatagaggtcctccccttcaatcttgtacatcatgttttccatctcggcaaagctcatcacaccgttgacaacattgctgcggatcataaacggcggtatataataagtgaatccgcggtcaatcataaagtcgcgcgcataggacagaatcgctgaatgcagacgcgcaatatctccacacaaataataaaagccattgccgcttgttttacgcgcactgtcaagatcgatcccgttgagccgctccatgatctccacatgatagggcacctcaaaaggtggaactgtcggttctccaaagcgttcaacctcaacattctcgctgtcgtcccggccgatcggcacagatggatcgataatattcgggatcaccatcatccgctcgcggatctctgcttcaagcttcgtttcaagctcctcaagctcctcaagctcttttgccatcgcagttacctgcgttttggcctgttcggcctcctcgcgcagacccttgcccatcaatccgccgatttgtttgctgatggtattgcgctgtgcgcgcagattatcgcagcgcgtctttgtctcccggaacttctggtcgcgttcaagtacttcgtcgaccagcggcagtttttcctcctgaaatttttttctgatattttccctgactgcatccggattagcccggacaaatttaatatcgagcatctttctacccctttcccgcttttttgaaaaaagcccggcaaaaaacttcataccttttttgaaaaaaggtatgccaaaaaactttagccggctgcgccgcgaacagtggggcagccgccgtcaatttatcgtctcttgcttacccctgccccctgtcgaacaacgccgccaggcctttcaggtcctgctcgtcataaaactcgatcactagccttccctttttttcaccctttttgcattctacacgcaccttgcgtgaaaggctctgcatcaaggcaagctgcacctccgcgaacgtactgttgtcccatgcggtgcgcggcgcttcctcctccgccttttccgcctgtttctgacgcttgacaaaggcttccgtttgcctgacagaccaaccctttttaatgatttcctccgccagcgcacagattacagcctcattttcaagaccgagcagcgcgcgcgcgtgtcctgccgacagctccccctggcttacgagcgcccgcacggcgtccggcagaccaagcagacgcatcgcattcgtaatcaccggcctcgatttacccacgcgctcggacacctgttcctgggtcaatccaaacgtttccatcagctcccggtatccggctgcttcttcaattggattgagatcctcgcgctgcagattttcaataagcgcaagctccattgtttcactgtcgctcaattcccggatcaccaccggcacctgtgacagtcccgccatacgtgcagcacgccaccgccgctcacccgcgacaagctgatagcctcccgattccatcggacggacgacaagcggctgtaaaacgccatactgccggatagaatcggccagctctgcaagcgccgcctcgtcaaaatggcggcgcggctggccgcggtttggttcaatttcgctgacagccagcgatgaaacagctccactgtccgtgctgttgtcggcaaacagcgcctccagacccttacccagtccgcctttcgcttttgccaaatcagttccccctttttttcctgttctttttcaagaattcttcggccagctcctcataggcggcgctgccctttgacgaacggtcataatacaaaaccggctgtccaaaactgggcgcttcggacaagcgcacattccgcggtatgactgtatggtaaatcttctgtggaaagtattttttcagctccgctacaacctgtaccgtcaaattaagccggctgtcatacattgtgagcagtacgccctcgatatctatatcgggattataaagccgctttacctgccgcaacgttgcaatgagttgcgaaagtccttctagggcgtaatattcacattgaattggaatcaacagagaatttgccgccgcgaaggcgtttaaagtgatgattccaagcgacggcgggcaatcaatcaagataaaatcatattgatcccgaatcctcagaagcgccgttttcagccgcatcgcacggttatcgagctcaaccagttcaatttccgcgcctgccagtgaaatattggagggaagcacgtccacgttttgaaacggcgtatgctggagcgcctgttcagccccagccgtggagacaagcagctcatatgtcgagcacgccaagctgcgtttattgataccaagccctgatgtggaatttccctgcgggtccacatcaaccaatagcgtgcggtatccgcgcgcgccgagcgccgcagtcaaattgacggcggttgtcgtcttgccgaccccgcctttctggtttgccaccgcgattatcttgcccattttttccctccggtaccctaaaagcgaatatctttccatcaacatggattgccttatgattataccacagcaacaagcccattcgggcttacctgccgcaaagcggcagggaaaccggcaaagccggttttgactgtggtgtaacatgcgcaatccgctgctttgcagcgtttgccgccatatggcggctgcaaacggctttgtcgtttgcactgcgcatattataccatgtccgcgaagcggcatggtataattgcccatcaaaaggcggttgccgcgcaagcggcgagccgctgggcataacccggtataataaccgctctgcggttattataccacattcatttctcaaagaaaagccttttgtcctgctcattcggccgcggcgccatttacagatcccatcactgaaccggacctttatacccttttatgtttcacgtgaaacatcgcagctttgttttcatttcttcaatctgcttttaagacgcaacaaagccgcccgtttgggcggcttgtgttgcagggaaacgtgtatttattttaccaaaccacagccgctttttcgggcgctgtcctccctgcgggcggcctgtggcggatggccttctttgttgttctattatgcgctgtgtggacggtatgcgctttttttcgggatgcgcatcgtataattgataaattcctcgtcctcaaatttttctgtatcaatatcgatcccagccagcttcatcgtcgaaaccgcttttgtgatcgtattcatgaagatacgaaagtccttcagtacaaacagcttggtcgctttctgctccggctttacaggcgcaggttccggcaccgcagtcagcattgtctcaatcaaccgttccgtttcacccacattcaggcgttcatgcgtaatcgtttccaacgcggcttcgatctgttgatcgctttccagcttcagcagcgcccttgcatggcgctctgtcaatcctgcatcaagcatccgcctgcgcagttcttcgctgaaattgagcagccgcagcttgttagcaatcgtagactgcgcttttcccaaccgttttgccacctgttgctgcgtcatatcgcacagctccatcagcctgcggattccctgcgcttcctcaaaatagttgaggtctttgcgctgtaaattctcaatcagcgcaaaaacggccgatttttcattatcaaactgttccacaatcgcggggattttatcaatcccattcatgcggcacgccatcaagcgccgttcgcctgcgatcagttcatagccgcttccaacagcgcgcactgtcacaggctggagcaggccgctctgtgcaatgctgtctgccagttcctgcatggcgcgcggttcaaattgacgccgcggttgataggggctgcgcacgatgcggtcaacatcgatcagaacaacacggttgacggtccgttgctttgaaaacttcatgctccccgcatcctttctttatcttgtccatgcctgcatcataccatgaaatattccaaatttccagcacttttcatcgcagaaaatagcaaaatccgccggtgttttcattacaccagcggattttttgctattttagcatgtggtcttggatattttgtcgatgtctgcgatcttttttttatcagcacaatcgcccggccgcttccatcaggcagcccaaggcgcttgaccgctttcagctccccacccagcagatgaacagcgcgcccagcttcggcacattccttgtcacaatcattccccttatatgcagcaaatattcccccggccctgacaaatggcaggcaatattcactcaattcatacagccgtgcgacagcgcgcgaaacagccatatcatatttttcgcgatagaccgggcttcgtcccacctcctccgcacgtgcatgaatacattcattgtcctgtcccagggactgtgacagttcttgcaggaatgtaatccgtttattcagactgtccagcagcgtcaaatgcaggtccggtcgtgcaattttcagcggaacggacggaaagcccgcccctgttccgacatcgacaagccgcgccccctgcgggatggggcaaagcgacagcaacgacagactgtcgacaaaatgcttgatcacaatttcctgtggttcagtgattgctgtcagattcatttttgcattccattcaaccaacagcgccgcataacggtcaaaagcatccaactgcgcagtgtcaagcgttacgccgaaaccggccgcatattcttttaacatgtcccgttcaatcatttgtttcctcccctgccttctgtgtggatgcatggtgctgactgagccaaatcaacagcacagacacatccgccggactgacgccgctgatacgcgatgcctgcccgatgttcaatggccgcaggcgcatcaatttctcgacggcttccagccgcagcccgccgatcgattgataatccagatcgcctggaagctgctttccctccaaacgccgcatctgctccacctgctcaagctgctttttgatatatccttcatatttaattgttatttccacctgttcgcagacctgtgcgggcaagtcagggcgctctggatcgaagggtgcaagcgatgcataggaaagctgaggccgtttgagcagctcacaaagacgcatccccgttgcaataggcgatgtttcacgtgaaacaagcaacgcatttaatttttcatttggcgctgtatgcaccgcacgcaggcgccttatctccccttccaccagttctcgctttttcaggaacgctgcccagcgctccgctccgatcaaaccgatttcatatccaaccggcgtcaaacgcatgtccgcgttgtcctgtcttaaaatcaaacggtattccgatcgtgatgtcatcattctgtatggatcgttgcagcctttcacaacaagatcatcaatcaaggtcccaatataactgctcgcacggtcaagcacaagcggcgtttttccctgtacggcacgcgcagcgttgataccagcgatcaaaccttgcgcggccgcttcctcatagccggaggtgccgttgaactggcccgcaccataaagcccgcgcactgccttgcattccagcgtcgcctgcaaacaggttggatcaaggcaatcatattcgattgcataggcgttgcgcataatgcgtatctgttcaaagcccttcactgtcctgtacagctttacctgtacttcctccggcaaggacgaagacataccctgcaaataaacctcattcgtatcaagccccatcggttcaatgaaaatctgatgacgcggcttatcagaaaaacgcacaaccttatcctcaatacttggacaatagcgcggcccaatcccttcaatctgtccgctgtaaagcggcgaccggtgcagattttccaatataacgcgatgcgtctgttcatttgtatatgcgatatgacaaactgctctgtttttcagcattcccccgtccgtttcgaaggaaaagggggtaatcggatcgtcaccctcctgtacctccagcgattgaaaatcaatcgaccggcggtcggcgcgcgcgggtgttcctgttttaaaacggcgcagcggcaaaccaagacgctcaagcgccgcggtcagttgatccgctgcatgcaaaccgtcaggcccgctttgcgctgtatactctccaacaaaaatacgcccacgtaaataagtacctgtacagagaataaccgcacgcgcatgataaagcgcacccaacgctgtcacaacagactcaaccgcaccgtcggatgccctgatatccactatttccgcctgtattacatcgagtcgatcttgattctccaccgcatgcttcatataccggtgataatcctttcggtccgtctgtgcgcgcagtgaatggaccgccggacccttccccctgttaagcatgcggctttgaagcattgtcgcatcagcagcacgtcccatctcaccgccgagcgcgtcaatctcacgcacaagatgccctttcgccgttccaccgatcgatggattacagggcatatttccgattgcatcaagcgacatggtaaacagcaccgtttgcgcgccaagccgcgcagcagctaaggcggcctctatacctgcatgtccacctccaataaccgcaatttcatacgttcccgcttcataatccatccatgattcccccttctgcatgtcactttcctacacaaaaccgtgaaaacacagaatcaacaaccgcctgtgacgcacgctttcctgtcaattccaacagcgcatcgagcgcgcgctcgatacaaacagcaaccgcatcgtaggaaacaccgttttccaaagcctctaccgcctcccgcagctccccggcggcagccatcaccgccgctcgctgacgcgtatttgctactatcgcagcggaactgtcaaaggcgcccaatcccaccatttcagtcaatacctccgtcaaaggcttcatgatattggtgtcatgcgctgaaatcgaaagtacgcgcttaaaatccgatgcaaaggcttgtgcatcgagcacctgcatcaaatcggccttattgaccaaggcaagcgcgttcaatccacgacaagcttccataacgcgccggtcatcccctgtcaacggctccgatccgtcaaacacagccaatacaagctgcgccctctctatctgttcaagcgccaagccgacgccctcctgctcgattggatcatccggctttcgaattccagccgtatctgtgagatgaaaaacaaaaccgccgcataaaaccgtatcgctgacaagatcgcgcgttgtcccaggaatatccgaaacaatactccgcttcacgcctgtcatcaaattcatcaacgaagattttcccacatttggccgacccacaatcacagtttcgataccctcgcgcacaaggcgtcccgtttcatacgatccagccagactgtcgagcctttgaaggcactttgccaaatcacactgtaaagcgttcggatcaaccgcttctatttcttcctctggataatcaatccaagcagacagatgcgccgcaaaataagtcagcctgtccgcaatctcccctacacatcgatacagcgcaccgccgcgcgccgataaagccgcgcgagccgcctgtccgccgtgcgcagagattagatcgatcaccgcctcagcctgcgtcagatcaagttttccgtttaggaacgcccgtttcgtaaattctcctgccagagcaggacgggcgccattcttacaacaggcattcaaaagacggtccattaaataaacgccgccatgtgcggatatctcgacgatatcctcgcctgtatagctgtgcggcccacgaaaagcagtgacgatcacttcgtcaatcggtccctcctgatcagcggccagaccataggcgcaggtatagcccgcgagtgaggaaaccctcccgcctttcgctaagcgcacgattctttcagccgtaccaaaagcatccggtcccgaaattctaacgattccaattccacctgttccaagcggcgttgcaatcgccgcaatcgtatcgatttcacccataacaatcctccactacaccgataaaggcagtcaacaaaaacatcataaagctgcattccctgttttacgtttattgacaaaggggaggatgtttcacgtgaaacatcctcccccacgatcatcaaacacttaaagatcaatctttccatacaacggcagatcatcaccctcatggcgcgcctgctggcggacaggcttctgctgcgtccttggtattggctgtgcagggcgttccaatgcgccttcgcgctccaattcggcagcataagcgcggtctacctctgtcgatgtcggcttaaccgtctccccacgcgtcgcgcggtcgtcgcgtcgaggaccgcgttccctgcgcggcgcgcgttcactcctctgctccgaatgctcgccatcgcgcggcacacgttcgtcacgacgcgccgtacgatttgctcccgcacgtccacgtcctccccggccgccccttccgccgccctgcagcggacgcggatttatcggcgatatcacaacacgacgattcggttcctctcctgtcgacgacgaggtaacaccctctattctcgcaacagtcgaatggataatcctgcgttcataaggattcatcggctcaagcgttgaaggacggccatagcgcaaaacgcctgcggcaagcttttgcgctagctgctcaagcgtcctctcacgtttttcacgataatttccagaatcgatcgttacacggatgtaatctccttcctcccggttggctacaaggctggaaagatattgcagcgcgtcaagcgtttctccgcggcgcccaatgatcacgcccagtccatccccggtcagacgcagaaccacgccattttccgttctcgcaacgcttaattcagcgtcaatttccattgcatttaaaacaccgcgcacatattcagccgcaacgcgcgccttcccttcaaccttctcaacttcgacaaacgtgattgtttgagccgccttttcctgcttttccatcccaacatgttcatttttatcctgcttcttcgcagtctcaacttgtgcgcgtgccggctgttcacgtttcggctcacgtttcggaacagacttctgcggcttcttttcagactgcgacgctctgtccgccctctgttcctttgtaggcgccgcctgcacctctttgggcgccggctgcctgtccttctttatttccgaaacaggctccggttcttcgacaaaaacacgtacccgcgcgggcgtattgcgcaagccgagaaagccgcgtttcggcaatgttataatctcaaaatccaccgcatcacgctgaacgccaagctctttacaagccagttcgattgcatcttcaacattgcgcgcttcttttattacctcacgcatccttgacacctccgataatataggggctgttgacaaaccaagccgtgccgataatgaaagcagacttttcggctgataaaacaaaaaacgcaggatgcccttcggggcttcacaatttttttgtaactgattccggaatcaagcgccgctgttttggctgcggcggctttgtcaacaggcccattaagggacgcttgtacacccatcgtctctttgcgccccatactccgggcggtctgcagaatttttttctgcaacgttgttttggaggattcacccggttttccgctttcgtaatcttatgatttcaggtcgtcgtccgttacctctgcatatgtctcgccgtatttctccgcgtcgcgtttgcgcgcagcagccagcttcaggcggttgatttccttttgggaaagcgcctgctcaatatccgtttctccacgttcacgcgcgcgtttcttcgcctctattttcgcctgccgttcggcctccctgcgctcctctgcttccttgcgcgctttttctgcaagctccttgggattcataaatttattaagcagatacgtttgaacggccatcaggatattagaaataatccagtacacgccaagtcccgccggcaccacgaaggaaatccatgcggacatcaaaggcatcataatcatcatacttttagacatgccggcagcggcagcggcgtttccgctcatatcggccgtctgacgcatcgatacaaacgaaacgagcagcgacgttaaaaatgaaaagatcggaatcagaatcaacagattcagcgcaaacgtcggctgctgcgtcaaatcgatcggcccgatcgacagatcgagcgtctgcaccttcgatacaaaatcgccaagtccggaaaaggcgtcaggatttgtattcaccgcatcaataatacggatttggcgcgaataatcctttgccaaattcgcattattcaacaccgtcgccgctatctcagtcgcctgatcgatcacaggaccgctgatacgcagcagatgcgtgatcgggcgctgaatcacgtcataaagaccaaagaggatgggcatctgaatgagcatgggcagacaacccgaggccggattgtaatgctcctcctcatagagcttcatcatttcctcattcattttttcacggttgttcgcgtattttttctgtatttcctccatacgcggccggaaaatctgcatttttaccatcgatttttgctgtttaatcgacagcggcaccaagcagacgcgcacaatcaaagtaaacagcacaagcgcgacgccataaatcggaaggaccttgaaacacgcccacataatccatccgagcggatagccaaatatcgtataaattaaggacatctgctttatttctccttcttgatagttcgccgcggcagcgtctcaggcacatgatcaatcccgcccggatgaaacggatgacatttcaaaatccgtttgaccgcaagccagcctccgcgcagcgcgccaaaacgggaaatcgccgtcagcgcgtattcagaacacgttggataaaaccggcaggtagaatgcggcttgagcggtgaaagatatcttctgtaaaaacggatcgccgcaagcagaaacgccttcacctcaacaatcccagcttttcacaggcgcgccgcagcgcttcaagcacctgctgcatggaaacgaacgctgtcctgacgcgcgcgacaagaacaaaatcatatccttgcgcaagctcctgttcaatcaaataaaacgcctcgcgcataacccggcgcgctcggttgcgcttaacagcctttcccacttttttagttgcggtcagccccagccggttttccccgctcctgtttttaagggcatagacaacaagcacaggtgtagcaaaggaacggcctctgtaataagcccgtttaaattccttattcaatgtcagcgtttggattttcgccatgctatctgtcctccagagcgaacagcgcgcagccttgcggcgtgccgtccggcgcggacaatgataaaaataaaggccacaacgcaagctgtggccatatccgcggcgtcggtcatcagccgcctgtctgtttatgcgcttaatgggtcaggcgcgcccttccctttgcccgcctgcgggccaaaaccttgcgtccgttgcgagtcgccatacgtttacggaaaccgtgctccttttttctctgaagctttttcggctgatacgttcttaccatcgttaaacctcccctcgtcaaggatgcgcaaaagaaccgctttagcactgcgttttcaccggcgccccgcggttccttcttttttaccttgcagataagcattataccgcatgtcacgggtttttgtcaatacctctggctatttttgccggctgtcgccgcagcctagcggtcattgaaagaagtatatactatataataatgtctatgcagccacccgttgaatacttgaaagaatcctgaatctgtgttatgataaaaaagatatcggttccgttgaaggactgtgtaaaaagcgccggtttaaacagacgcccgctgcgttctcaaccggttatccactcagattattgggaggagtacccctgttatggattcattcgcagaattatttgctcttgtccttgacctctgcaaaaatcagatctccgacgtcgcctttaacctgtggctcaaggatatcattcctctgcgcttggaaggctcggccgctttccttcaggttaattccgaatttaaaatgaacattatccgtgaaaaatatacttccatcctcaagtcggcttttgaaacgacgttgggttttccggtcgatgtcatcattacctgcgaaacgccgcagccggctgaaaaaccggccgggccgccgccttccgacgcggcggccgtcaacggtgaatatgactatacgtttgatacgtttatcatcggctcctccaataaatttgcacatgcagcctcccttgctgtcgcggccaaccccgcaaatgcctataacccgctgtttatttatggaggctccggtcttggcaaaacgcatcttctatacgccatctgtgctgaaatccgcaaaaaccgcccaatttataacattatttatgtaaagggcgacgaatttgccaatgatattatcacagccatccgcgaccagcgcacggctgaattccgcgaacgataccgtaaagccgacgtgctgctcgtagacgatattcaattcatcggcggcaaggaaagcacacaggaagaatttttccatacctttaatacattatacgaatcaaacaagcagattgtacttgcgtccgaccgtccgcccaaggagatcaaaacgttggaggaccgcctgcgtacacgctttgaatggggtcttttggcagatattcagatcccggattttgaaacgcgcattgcaatcatccggcgcaaagcgcagcttctcgatattcagatgccggatgatgtcgctgaatatattgccaatcgccttaaaacaaatatccgccagcttgaagggactgtcaaaaaactgaaagcctataagctgctgcagggaacaaacccttctattatgatcgcacagaatgcgatccgtgacatcctcaacgacaaccagccggtccctgtcactgtcgagcgcatcatttccgaggtgggacgcacatacggcatctcgccgcaggacatccgttcaaacaagcgcagcgcgcagatatcagcggcccgtcagatttctatttatatcgtccgtgaaatcacccaaatgtcgatgtctaccatcggcgacgaattcggcggccgcgatcacagtacaattgtctatgcaattcagcaggttgaaaaaaacatgaataacgatttgcggtataaggaaacgattgaagatattataaaaaatatccgtgacagctagtttttcactttctacttttccacattttccccaatgtggaaaacaacctgaaaagtcttccacgttttccactaagttttccacattttttctcatttaacatccagttttccacagcatcgttaatatcaatgcgctttttaaagattttcacaattctgcaacgacactctccaatgaaaaaaagcttctaaattggctctgcaagccactctgcaagcttttatacatctcaacgtcccctactactactacgatccttatatacttactttcttataataaggacggaaaataggagtgtggaaacataaactgcatgtgaaccacgaaaggaacagtctcttagtatagcccgataagctcaatgcctatcccattgttcgcggcgcaacctgtatcaacgcagtgccaaacccactgttcgcggcacagccgactaaagtttttcgccgaggcctttttgaaaaaaggccggaaaggagatatttatgcagttaatatgtgataagcagctattagtggatgcggttgcaaacgtttcgcgtgctgtttcttccaaaaatacgctggctgcgctggaaggcgtttttcttcgcgctaaaaataatacgctttcccttactggctacgaccttgaactggcaatttcaacagagattgaagcggatgtacgcgaagcaggtgaaattgttttgtccgcgcgtattttccttgatatgatccgccggatgcccagcgagcaaatcagcatctcaagcgacgcaaaaatgttgacgctcgtaaaaggctccatgaccgaatacaccattctcgggcttcccgcttcggagtatccggaactgcctggcgtttctgaaacgacggagctttcaattccgcaggcggctttaaaaaatatgatcagccaaacgcttttcgcgattgcggtcagcgacagcaagccggttcatactggttccctctttgatattaagggcggcgagctgtgccttgtatctgttgacggttaccgtctggcgctgcgccgcgaaaaggtggcgtttgacgaaactctttcctttatcgtgccggggaaatcgctctccgaggtttcaaagctgctgcgcgatgaggaaggggatgtcgaacttggcgtagcgcggcgtcatattatctttcgtacaggcagctaccgcattgtatcgcgcctgcttgagggcgaatttctcgattatcgcgccgccattccagagggtggagcgacgacagtaaaaatcggcacgcgcgatttgatcagcgcgatcgaccgcgcgtcgctgctgatctcagataatataaaaagccctctgcgcatgaaatttgaagaagggctgattaaaatttcgtgttccacggccatcggtaaggcgtatgatgaaattcgctgcgaacagagcggcgacgatgtggaaatcggttttaacagccgatatatgctcgacgcgcttaaagcgagcgaaggagacgaaatccgcgtgctgattaacggtcccctctcccccatcaagctgatgccggtcgaaggcgatgcgttcgtgttcctcgtgctgccggtgcgcctcaaatcagaataagcggcgaaaggatgtccctatgcaggtaacaatcacaacgccgtttatcaagctggacgcgcttttgaaatttgcgggcgccgtacagactggcggtcaggcgaaggaatggataacaggcggcatggtgcgggtaaacggagaactatgcgcaatgcgcggcaaaaagatcaggccgggcgatcttgtaaacgttggagagcttgaaatcgaggtttgcgcgtgagaattgatcgaatccgtattacagatttccgcaacattgcatcactggagcttgcgctctgtcccggcgccaatgtgatctatggcgacaatggtcagggaaagacaaactttattgaagcagtgtggatgtgtacgggagctaaaagcttccgcggcgcaaaggatgcgcagcttgtgcgcttcggcgcgccgcaggcggcggttgaagctggtttttatgcggccggacgcgaacagaaggcgcttttgacgattgaaaaacgccgcgccgccgcgctcaatgaggtcccgttgaaaagcgcggcagagctggcgggccagttctgtgccgttgttttttcgcctgcgcatctgacgcttgtaaaaaacgggccgcatgaaaagcggcgttttattgatacgtcgatttgtcagatcaagcctaaatacattcatgttctcaatcaatacacaagggtgcttgatcagcgaaaccggcttctgaaggatattatgtatgaaacaagcttgtttgatacgctcgatatatgggatgcgcgcctggcggcatatggcgcagttgtaataaaaacgcgcgcgacgtttctggagcggcttgcgccgtgcgcacaggagatttacggtggtcttgcaggcggacgcgagaagtttggagcgcggtatgcgccgtctctggctgtcgatccaggagcgtcgatgagcgaaatcgaacagcgtgcgcttgaggatctgcgggcacaccgcggtgaggatatccgcacacgaatgacaggagccggaccgcaccgcgacgatatagatttgacgcttgacgggcagagcgcgcgcgcatttggttctcagggacagcagcgaagctgtgtgttggcgctcaagctcgccgaatgcgagttgatccgtgaaacgctcggcgaatatccggttgtgctgctcgacgatgtgatgagcgagcttgacgcagcgcggcgcgattatttgctcaatcatttacagggacggcaaattataatgacaagctgtgatggcagtgatttcaagggattgtccagcggcgtgtctgtgcggatcgaagacggccgcgccgcagccagcagcagccatgggatggacagcgtgaaagaacaggaggaatagcatgtatttgcatcttgggcaggataccgttgtccgaaccggcgatgtcgtcgggatttttgatctggagaacagctccgtatcgaaaatcacaaaggagtttcttgcaaaatcggaacaaggcggacgtgttgtcaatgtgtcctatgagctgccaaaatcgtttgtgatctgtgttgaaggacaaaaatcaaccgtctacatcacacagatttcttctacgacgctgaaaaaacgcgccgggtttatagatggcatctccaatgtatgaaaaacagcatcctgaaaggagtggatacagtgggggatcaaaacgagctgaatcccggtattgtgccggatgagcaggagtacgacggttcacaaatacaggtcctggagggcctggaggcggtgcgcaagcgccctggcatgtatattggatcgaccggaccgcgcggcctgcatcatctggtgtatgaaatcgtcgataactcgattgacgaagcattggctggacactgcacaaagattgaagtcgatttgctgcctgggaatatcgtaaaggtaagcgacaatgggcgcggaatcccggttggtatccagccaaaacttggcatcccggctgttacggtcgtctttacggtgctgcacgcaggcggtaaattcggcggcagcggctacaaggtgtcgggcggactgcacggagtgggcgcgtcggttgtaaatgcgttgtctgaatggcttgaggtcgaggtctgcgacgggagcgcgcggtattatcaaaggtttgaacgcggagtagcggtggaaccgcttaaaaataccggaccgacagaggaaaagggaaccagcgttgcctttaaagctgacgcggcaatttttgaagaaacgacggaatacgattatgatacgcttttgcggcgcttgcgcgagcaggcgttcttaaacgcgggcgtttatattgttctgcgcgatcagcgtgggacagagccggttgaggagcatctccattacgagggaggcattcgaagctttgttgaacacatccataaatcaaagggtgtggagccgattcatgacgaaattatttatttggcggcgcgcgacggcgataatacagccgaggttgccatgcagtataacgacagttatacggatttaattctatcatttgccaacaatatccacacgacggatggcggtacgcatgaatccggctttaaaacggctttgacgcgcacaatgaacgattatgcgcataaatataagctgcttaaggacgatgaaaagttttcgggcgaggatgtgcttgaagggctgacagcgattgtttccgtcaagctgacagacgcgcagttcgagggacagacaaaggcgaggctgggcaacacgcagatgcgtgcaatggtcagttcccttgtctatgaaaagctgacgacgtattacgaggaaaacccggcggttgctaaggcgattatcgaaaagtcgatcaatgcctcgcgcgcgagagaggctgcgcgacgtgcgcgcgatgtcgcgcggcgcaaatcggcgcttgagacggcttccctgcctggtaagcttgccgactgttcgcagcgcggccgggatggaacggaaatctatatcgtcgagggtgattcggcgggcggttccgctaagatgggacgtgaccggcggttccaggcgattttgccgttgtggggcaaaatgctcaatgtggaaaaggcccgtctcgacaaggtgtatggaaacgacaagctcatgcctgttattacggcgcttgggaccggtatcggcgatgaattcgacatcgaaaagcttcgctatggcaaggttatcattatggccgatgccgatgtcgacggcagccatatccgaacactgctgctcactttctttttccgttttatgcgtcctttgatcgaacatggtcatgtttgtatcgcacaacctccgctgtttaaggtcagccgcggcaagcaggtgcggtatgcattttccgatgaggagcgcgatcagtatatccgcgagctttgcccggatggaagcgggaaagcggatgtacagcggtataagggtcttggagagatggaccccgaacagctatgggagacgactatggacccgcgcaaccgcacgatgctgcgggtggagatggccgatgcgatccgtgccgatgaaatctttacagtgctgatgggcgacaaggtagcgccgcgcaaggactttatcgagcaaaatgccaaatacgttcagaaccttgatatttgatggaggcgaacgggcttttggaccggggctggaaaggagacgacacatgcaggaacaggaaaacagcagacagcagccggacgaagcgccggccggggatgtgcaggaacaaagcggcgcgccgtctgagcagaatcaaccggcgcaagtcatgcaggaggaaacggcgcagatgccggctggagcaaaggaatcggacgctttggcaaagcaggcggatgaaacggaagacggcgagacggcgtccacatatgaaaagctgtttacgctcaaatttcatctgccgcttgacgattatatcgagttttaccgggtcatgacggctgacagcattgacaaaaataaaaagcgcatgacaatcatgggcgcgattgtgctgttgatcggactttttttgcttgggactacagttgcgggcatcaatcccatgacgccggtttcaatgatcctacttttgatggtcttttttctcggttttcgcagccttttttattacaaattgttttatgataaggcgcttatacgtgcagtaacgaaagaatacaacaaactgaattatttgcatgcggagatggtggttgatttctacccaaataagtgtgtcgagcatgtcaatgaacagcgcgtcgagacatattggcacacgatccattccatccgcgtaagcgccgggctttatatgatcatgctggcggagaggcgctgcctgttgataccaaaaagtcaggccggagaacacagggaggaaatggaggcgctgctttccgatatctgtgtaaactttgagaaaaagaggtatgacgtatgagcgaagaagcggccggcggactgccgggaagccagcaagacgatgtggacgtgcggccgcaggaaaatgatgtgctgcacattacttttcaaacacgccgcgacgacgtactcaaggcgttggaggtttatgataagaaaaaaaagattgatatgcaccgcaatatggaaatcctgggtgtgtttgttgtgctatggatgtttgtcccctatgcgttcgaggacccgggacagattgtcagttggattatgattgcagcagccctggcactgcttgggttgatcctgttttatccgaagcatgtcaatcagaaggctgccgccgcgcgcgaagccgggtcgccggaatatgtgcttatggtaaacgcagacggtatcgatgtggcagagggcggcgctcattactatatcgccttttcaggagccgtcaacgtatatgattatgaaggcgtctatgccgttgcctttgataaggggcgtgtctttggcattccgaaaaatcagcttgacgacgatttgttggatcgtctgcgcgcgctgctgggacaggcgctcggcgaccggtttgaaaaggtttacagcgcggccgaacggcgcgcgatggctaagatgggacggcgctgaacggcaaaagttccccaatgataggagatgatacggatgaaacaggaacacgacgccaaggacgaggcgtttgatcccgttctgatagaacagcgcattcacaatgtcgatatcgagcatgaaatgaaacggtcgtttctcgattattcgatgtcggtgattgtcagccgtgcgctgccggatgtgcgcgacggattaaagcctgtacaccggcgtatcctgtatacgctgcatgaaaacggcctgacgcctgacaagccgtaccgcaaatgtgctgataccgttggatctgtgcttggccgttaccatccgcacggagacgcgtctgtttacgatgcaatggtgcggctggcgcaggatttttccatgcggtatccgctggtcgatggacacggcaactttggctcggtcgatggagatccgccggcagcctatcgatacacagaaagccgcatgagtaaaatgtcgctttctatgctgaccgatattgaaaaggaaacagttgattttaccggaaactatgacgatcgccttcaggagccgacggttttgccgtcgcgtttccctaacctgctgtgcaacggatcgacaggtatcgccgtcggtatggcgacaaacataccgccgcacaatctcggcgaggtgatcgatgcggttaatctgctcatcgataaccccgacgcgggccttgacgagatcatgcagcatatcaagggtcccgatttccccaccggcggcgtgatcatggggcgcgcaggaatacgcgccgcatatgcaacggggcgtgcgcggttgacgctgcgcgcgcgcacggaaattgaggagatggcaaacggccgggagcgtattgttgtaaccgaaattccatatatggtcaataaagcgcgtttgattgaatcgatcgccgacctggttaaggataaacgcattgaccagatttctgatctgcgcgacgaatccgaccgtgacggtatgcgcattgtgatcgaattaaagcgcgacgcaaatgcgcaggtggtgttgaaccgtctgtacagttacagccagcttcaggatacggttggagtcattatgctcgcgcttgtgggcggcgtgccgaaggtgatgccgctgaaggatgtactgacacattacatcgattttcagggtgaaattgttacacggcgcaccaagtacgacctgcgccgtgcgaaagagcgtgagcatatcctggaggggcttaagctcgtttgcgacaatacggacgaagtgatttcgatcatccgccattcaaaggatcgtcccgattcgaaagtcaatttgatcgcgcgctttggcattactgatattcaggcgaccgcaattgtggctatgcagcttggacagctttcaggtcttgaacggatcaggattgaggaggagcttgcaaaaatcctggagcgcgtaaaggaatatgaggcaatcctcggcgactatacgcgtgtgatgtcgatcgtcaaggaggaattgggagtcctgcgcgccaaatacgcagacgagcgacgcacagagattgtcgctgtcagcggggaggtcgatatcgaggatttgattccggttgaggactgtgtgattacgctgacacactttggatatctcaagcgccagccggtcgacgcatacaggacgcagcggcgaggcggtcgcggcgtcagcggaatgacgcggcgtgaggaggacttcgtcgaggagctgtttatctgttccacacatgacttcatcatgtttttcacaagcaagggacggtgcttccgccttaagggctatgaaatcagcgaagggtcgcgtacatcacgcggaacaaatattgtcaatctcctttcgatggacagcgacgaaaaggtaacggctcttattaaggtgacgcctgacgaatatgagcgtgaggatcgctgccttgttatggtgacgcgcaaggggattattaaacgaacgccgctgggcgcgtataaaaatgtgcggcgtatgggactgattgcaattggacttgacgatggcgacgagctggcgtgggtacgtcagacggacggtacaagcgaactgattatcgcaacgaaaaacggtatggcgatccgtttcgatgagcaggacgcacggccgttgtcgcgtacagcgcgcggcgtcaaggcgatcacgctggaggacggcgacgaagtcgtcggtatggcgcgtgtcaggaaggaaagcggcgcgacgctgctgactgtctccgaaagcggtctgggccggcgtacagaagtgtcgcagtaccgtctgcaaagccgcggcggcaagggaatccgcaactattatgtcgataagaacgggccggttgcaggtgtgcgcatggtcgacgaggatgacgatgtgattatcatcaccgacgatggcgttatcatccgtattcctgtgcgtgagatcactgtacagtcgcgctatggcggcggggtgcgcgcaatgcgcgtatccgaggaaagccgggttgtgaccctggcgcgcgctcccaaggaggagacttccggggatgacgggcaggaggaatcacaaatcgccgcgggggacgaagcagccggcgaaactgacaaaacggcagaggatagataaaggaaaaaaaacggccccaaaaggggccgtttttatgttgtggcagaggtagtatgctcccgctgcttataatgcgtgcaggccttggcgcctgcttcacgaattttcagccgcgggtaaacacagtgaccgaatttaatttcacggtagctccaacccagtttgacataatgctgcctgaaatatgcacagtttttacagatatggtcctcctgatccatatactcacctcatttttgatcgctttcacaatgacaacagcccttttccgttcagaggcaaaaagaacagatggaatgcagttgatcgcctgattatcaaaaaagagaagattaaccccttatgccggaaaacccggcgaaccgtgccccgcaagggaggagaaaagaaatagacggggcgacggatatccattatttgtcctgcgtccgttttacctttccaaaatatttcgtactgtaaacaatatacttatcctgataaccggtatcatgctggtcagcgcgcaaccgtttgtaagcgtggcggtcgatttcaacaagtgagctgtcataggtcagtacagattcacccacatttgaacagaggtcggagatgcgctcaatgttggagagcgcctcaacatacgggaaagcagcgtcgacggtgcattttccacggcgcagacggtcgatatgcttgtcctttagcatttgttcaagctcgtcgacaacctcctcgagcggcgcgatattggcggcggcagtgcggttgacattctggaaagcatcgaccgcaagatcgaggatttcatggactgcctcgctgatcgtatgcatttcctctgtcgcctttttggaaaaagtcgtctttgtatcgaccatgcggtcggcgcattctgcaatattctgtgcgtggtctgcaatgcgctcaaattcgccgcatgtgtgcagcagctcggatatgctgcggttttcactttcagacagctcgcgttcgccaagcttgagcagatacgtttcaacacggtcctccagcttatcgacaacatcctcattttcctgtatccgatcggctattttttgatcatagcgatcgagcagcgcgacggaatcaagaaaattggagcgagcaagcaacgccatctgtacaacggcgccgcgcacatgctcaagcgcaaggccgggagatacaagcaggcgttcatcaagcgaggctgcggtgatttcctgttcaccttgacctggcttatccttcacaatggtgcaggcaatccgttcgagaactccgacaaacggtataaagagaatggtaacggtgagattgaatatcgtatggaaattagcgatcatacctttatcgaccggcaaatcccagaaggcaaaatgaaggatagactggagcgcatagccgcaggtaaaaaacaggatcgtgcccaacacattgaaggtcacatgtacacaggcggaacgctttgcgtttttggtcgcgccgatcgaggcgagaataggggtgatcgtcgtaccgatattttgccccatgatgatgggaaaggccatgccgaaggtaatctgtcctgtcgaggagagcgcctgcaaaataccgatggacgccgacgacgactggataagcgccgtgacgcctgcaccgacgagcacaccgagcagaggaatgttgcccatcgcagcaaaggccgcggaaaactgcggcagctccgcgagcggcttaacggacgattccatcgtaaacataccagtaaagaggataccgaacccaatgaaaatggagcctatatcgcgggccttgttgcgtttggccgtcataatcaaaaggataccgacaatacaggccaacggcgcaagcgttgtcggcttgagaaagcggaaaaaaaggttggaggaatcgagatcggacaggcgcaggatatgagctgtaaccgtggtaccgatgttagcgcccatgatcacgccgatggcgttgcgcagtttgagaacccgtgcattaacaagacctacaacgataacagttgtcgcagaggaggactggatggcagcggtaacaagcgcgccgagcagcacgcccttgatcaccgtatccgtcagcttctcaagcgttcgttccaaacggccgccggaggttttttcaagaccgctgccaagcagtgtcataccataaaggaacattgccaggccgcctaacatactgatgatcataaaaatatccaagctgttcaccacttcatttttcttgaattttatacactttttacgctatataatttcattatatcggaaacgggaatgtttgtatagtcccttttttgccggtttgagtgccttttccgcttaaggcgcgcatttgtatagatgtccaaagcgaggacaagctctttttgatctattgtattttttgtccaatagcagtataatataaaaatagatcgccggctccatgcgcgtcaggtccagatcaatcaaatatacttgcccatggcggggacaattttgccaagatagttgctttgcaactatttttatagattgcacagcaatctataaaaatcctttatgtgccgcagcgggaaggcgtttatggattaaagaagcgtcgctatcaaaagcgtctcgaccagacgcgcataaattggttcaaattcctgaatgggaagcgggtttttaccgcggccgatttcgaatgtgaacccgggacgccgcatacaatcaataaaccagtctttaaacccgccatgcgaagcagttccctccggcgacgccagccggtaaccgcatgaggaagcgaggacctgcgccataagctgacttctggcgggcgtatgcggaccatagcggtaatagatttcttctccctgggaatggaacgcataggcagtacgcggtctgaaggcggcgcaaaagttgacaagcgcgcgtgtttccggttcgctgtggggcgtgtggcccccgtagcgtgttggaccgggcgcatcaataccggccgcccgttcaagctttttgacctgttcaaaaccggcgtcaaaattgtggttaaggtctattccgcgtgcgttggcctgccaatgcagcgtgtcgccgccgcttgctttttctacaaacgcctgtaaatggcccgctgtgccggcgccgccaagtgaaatttccatgccgtcggggttgaggcacgggatgagtgtaaatggccggttttcaagggtatgggtcagatcaatgtcagccaacggctcgcatgttgatatggcgcgtgcggcatcctcggcgaagcgcagcagcagcatggttgtcagccactccattccgtgtacgccgccgacaagcagcgcgccgctgccgcctttgccaaaaccaagcgcataaagcccgcggccaagtacggatttgccaatcgggaaggcatgtataaacgggtattcatcgcgcagagcgcacactgcctgccggatatgctcaaagcggggcggctgtttgtaaaatccgtcaaacatattgtttcacctctaagcccagtgtatgtgccaaaacgcttgtattatggcagttcggcacaaaaaaaggggatttgaggcggacatgcaaactcagttcccggcagcaaggcgggatgagcaagggggttgccaaattggctcattatgaaaaaacaatcgattccaaggtgatttatgagggaaaaattctcacgctgcgccgcgacacagtagaactggaaaatggaaatcacgcggcgcgcgaggtgattgatcatccgggcggcgtggcggttttggctatcgatgagcatgagcatattttgtttgtatcacagtttcgttatccgttcggcggcgtcatgctcgaattgccggccggcaagctggagcgcggggagaacccgcaggaatgcggcgtgcgcgaattatcggaggaatgcggatgcaaggcggactgttttgtaccgcttgcgaggatgtatccaacttgtgcttacgatacggaaatcatacatatttttctagcgaccggccttcatcagtcgcggcagcatcttgacgaagatgagtttttaactgtccggcgcattcctgtggaaaaagcggtgcagatggtgctcgacggtgagattccagatgcaaagacgcagcttggaattcttaaatatgacgccctgcgccggcgtggcaatcaaaactgaaaacaaggccttaaaattggccatgccggttttgtaaccggcatggccaattcgcttctgtaaaaatagtagagaagtgcctgaaaatgaatcattcagcgcactctatataggaaaacattataacttggaaatttataccgattatccaaagtagtaatttttcattttctgcacacactaacaccgaagtaaccatgttatttcaagctgtatttcttggtttcccagtttaattgtgaaaggaagaaatccaatgaaagctatcaaagcgattttcgcggcggctttgacgcttgcgctggtcgtttccatggccgcatgtacgtcccgcaatcaggataatatgcagtcgtcgagcgttgcgcattcgtcgtcggccgcgtctgtggctccgtccacaccgtcgacgccgtctaccccgtccacaccgaattctgcggcttcgcatggccttgcctccgatcttggagatgtgacgagcgacatccgttccggcgtggccagtatggtaacgccgaccatgagcaccgattttgacaaaatcggtgctctgggcggcagccagatcaagtgggggccaggcgtgcaggtagacgaggcaaaccggacgatcgctccgatcggcttgcaggagcaatatggagaatacagcgcctggtttattgcgccggacgactgtggcaaattttacttaacgtttgatgaaggctatgaaaacggttatacagaggaaatcctcgatgtgctcaaggagaaaaattgcagcgccgtcttttttgtgacgctgccgtatgtgcagtcgtgtcctgagcttgtgcagcgcatgatcgacgaaggccatgttgtgggcaaccacacaagccatcactggaatccaacgtccaaatcgattgatgatgcggccgaggatatccgcgagcttcacaactatgtgctggaaaacttcggctacgagatgacgctctatcgtccgcccgaaggcgccttcagcgaacagacgctcgcgatggcgcagagccttggctatacgacttgtctgtggagttttgcttataaggattatgaccccaacgatcagcgtggccatgacgcggcgctcgcctatacggaaaagtttatccatgaaggagcgatttatctgctgcacgcggtcagcagcgacaacgcttctattcttggagaattgatcgacgccgtgcgcgcaaaggggttggaagtttcaaagtgggacctgccctattgcccgccaaaatcgtaaggtgcccggcgcatcagccataaacgaagataaagaaacgctccgtatcggccggcagacggcggtacagggcgttttggcgttagaatggacggagggaaaaacagagcggcgttctcccaaaacggtgaaagcttgcaggagatcgcgccagccgcgcggcgtctggcacgcctcctgctggcggaagaccctgcgtctgaacaggctcttgcggcctgagggccgcgctattatgagggctgcggcccggggaaagggcgctgccctcgaaaaaaggcaagacccgcgaggggccttgccttttttctcacccgccgccttttgaaaaaggcgggcgaaaacttttgattacgatgcgctaatctttctgttcgcggcgcagccgattaaagtttttcgccgaggccttttttcaaaaaggccggagcgcagccgactaagtttttcgccgaagccttttttcaaaaaggctggagcgcagccgactaaagtttttcgccgaagccttttttcaaaaaggctgggggttattcggcgtcgcggccgcagcacttcttgtacttcttgccgcttccgcagggacagggatcgtttcgcccgacctttttgacggtgcggggacggttttcaagcgtgccgtcgctttcgccgcggctctcctgagcgggcttggcaacctgctcgcgctttggctcctcgttagtgcgcaggcggattgtaaacatcatcttgaccgtgtcctcgcggatcgattcgatcattgcgtcgaacatgtcaaagccctcgatacggtattcgacaaccgggtccttctgcgcgtagccgcgcaggtgcatgccgcgtttgagttcctccatgtcgtcgatgtgctgcatccacttcatatcgacattgcgcagcagcacgacgcgctcgatctcgcgcgtgatcggcggggtgaactgcgcctcgcgcgctgcatagatcttttcagcgcggtcgttgagcatatccttgatctgctggtctgtcacctcgccgagctgttcggtcgtgtagcgcagatcctcctgcgttgtcagccagccgaggaagtagtcgcgcaagccctcgagattccagttgtcatggacctctttatcaacaagataacggtcaacggtggaatcgatcgtctccttgatcatgttcttgatgatgccgctgatatcctcgccgtcaagcaccttgtcgcgctgtgaatagataatttcgcgctggcggttcataacgtcgtcgaactggaggacgtttttacggatgccgaagttacgcgcctcaacctttgcctgcgccgattcaatcgagttggtcagaatcttcgcttcgatcggcatatcgtcgtcggcgccaatcatgttcatcatattctggatgcgctcgccgccgaacagacgcatcaggtcgtcctccagcgacatgaaaaagcgcgtctcgcccggatctccctggcggcctgcgcggccgcggagctggttgtcgatgcggcgggattcgtggcgctccgtaccgatgataaacaggccgccagccgcgcgcaccttctccgcttcaacggaaatttcagcgcggtactgatccatcagctcgcggaacatctggcgcgcctcgcttacctgctcgtcgtccgtgtcggcaaagcccgtcgcctcgctgatcacctcgtcgtcataaccggccttgcgcaactgtgccttggccatatattccgcgttgccgccgagcatgatatcggtaccgcgtccggccatgttcgttgcgattgtgaccgcgccgtactggccggcctgtgcgacgatctcggcttccttctcgtggtatttggcgttgagcacctcgtgcctgatgccgcggcgcttgagcatcccggagagcagctccgacttttcgattgaaatcgtaccgaccagaacaggctgtcccttttcgtgacattcgacaatgttttcaatgaccgcgttgaatttcgctttttcagtcttgtaaacaacgtcgtggtggtcgacgcgctggacgggcttgttcgtcgggatttcgatgacgtcgagcttatagatctccataaactcgtcggcctcggtcatcgccgtaccggtcataccggcgagcttgtcgtacatacggaaaaagttttggaaagtgacggtcgcgagcgttttgctctcgcgctcgaccttgacgccctccttggcctcgatggcctggtgcagcccctcgttatagcggcggccgagcatcaggcggccggtgtattcgtcgacgataatgacttcgccgtccttaacgacatagtccacgtcgcgctgcatgatgccgtgggcgcggatggcctggttgatgtggtgctggagctgcatattgtcgccgtcggtcaggttttccacaccgaaatattcctccgcctttgtgacgccggaggcggtcagcgtgactgttttggctttttcatcgacgatataatcgccgtcgacgtcgtcatgctcctctttggagtccgtctcggcgacgcggtagcatttgagcgtgcgtgcaaagcggtcggcgcgctcataaaggtcggtcgacttgtcgccctggccggagataatcagcggcgtgcgcgcctcgtcgatcaggatggagtccacctcgtcaacgatggcgtagttgtggccgcgctgcaccttgtcgcgcttgtagatgaccatgttgtcgcgcaggtaatcaaagccgaactcgttgttggtcccataggtgatatcgcaggcgtaggcgtcgcgccgctgctgcgtatcaaggccgtggataatcagaccgaccgacaggccgaggaaacggtagaccttgcccatccactcggagtcgcgcttggccagataatcgttgacggtgacgatgtgcacgcccttgccggtcagggcgttgagataagcgggcagcgtggcgacaagcgtctttccttcgccggtgcgcatctcggagatacgcccctgatgaaggatgatgccgccgatgacctgcactgggaaatggcgcatcccaagcacgcggtcgctcgcctcgcggcagacagcgaacgcgtccggcagaatatcgtcgagcgtctcgccgtttgccaggcgttctttaagcgccggcgtcacagccttcagctcggcgtcgcttttggccttatatgtttcttccagcgcaagaaccttttgctggatcggataaacgcgctttaactctcgctcggaatagcttccgaacagttttttaatcagacccattttgtcacctcatcctatattcccgaccctggcagcgcaaagaaacgtcgtttatttggtccgcttcacagattcccttcgcgcgcgggcgcctttgcatttgcgcacaattcaacttatatagtttactcccagccgccgtcaatgtcaacagattccagtgtttttaaacgtttgcggccgcgcgcagacggatatctttattatatacaaaaaatcgcccgaaatcaggacgaaattgttgtccaagaattaacaaaagctgaacaaatccccttgcgtgcgcgcggtgaaatgcctataataagaaatggacaacccgttttaaaaaaccgaaaggagcaccgatatgaactattcccatgaagtggagagaatgtgtgttctcgccaaaggccccaagcatggccccgccccgatcccggaagagggcaaatgggtcaaggcttatgaaatcaaggatatttccggcctgacgcatggcgtgggctggtgcgccccgcagcagggcgcgtgcaagctgacgctgaacgtcaaggagggcgtcatcgaggaggcgctcgtcgagacgcttggctgttccggcatgacgcactctgcggcgatggccggcgaaatcctgcccggcaagacgattctcgaggcgctcaacaccgacctggtctgcgatgcgatcaacgttgccatgcgcgagctgtttttgcagattgtttacggccgcagccagaccgcgttttccgagggcggcctgcccatcggcgcgggacttgaggatctgggcaaggggctgcgttcgcaggtcggcaccatcttctccaccaacgcaaagggcgttcgctatctcgagctggcggaaggatatatcctgtctgtggcggttgacaacaacaacgaggccatcggctacaagtttgtccgcgtgggcaagatgcttgaggacatccgtcacggcgtcgacccgaaggaagcgtatgaaaagaatatcggcacctacggccgctatgccgacgcgccgaagtatatcgatccgcgtgaggaataaagggagagggaggtaacaacatggttaagtttgaaggacaggaaagaagaatgcccaaaatcaacgcgtgcctggcggaatatggcatggcttcccttgaggatgcgcgcgccgtctgcctcgataagggcattgatgttgaaaaaatcgtgaagggcgtgcagcccatcgcgtttgaaaacgctgtctgggcgtatacgctcggcgtggccgtcgcgctcaagaagggctgtaaaaaggccgccgacgcctccgaggccattggcatcggcttgcaggccttctgtgtgcccggttctgtcgctgagacgcgttccgtcggactcggtcacggaaatctcggcgcgatgctcctgcgcgacgagacgaagtgcttctgtttcctcgccggccacgaatcgtttgccgccgccgaaggcgctatcggcatcgcccgcaacgccaacaaggcccgtaaagagccgctgcgcgtgatcctcaacggccttggcaaagacgctgcctatattatttcccgcatcaacggctttacgtatgtcgaaaccgactacgatttcgccacaagcgagctgaaggtcatcggcgagacgccgtattccgacggcgaacgctccaaggtcaaggtctatggcgccaacgacgtgcttgagggcgtcgccattatgaagcacgaaaaagtcgacgtttccattacgggtaactcgacaaacccgacgcgtttccagcacctggttgccggtacgtataagaaatggtcgtatgagaacggcgtcaaatatttctcggttgcatccggcggcggcacgggccgcacgctccacccggacaatatggccgccggcccggcttcctacggcctgaccgattccatgggccgtatgcacggcgacgcgcagtttgccggttcgtcctctgtcccggcgcacgtcgagatgatggggctcatcggcatgggcaacaatccgatggtcggcgcgaccgtcgcctgcgccgtcgccgtcgaagaagccctcaagtaacgccccgcttttttgaaacttaccttttttgaaaaaaaggtaagccaaaaaactttccggcttttttgaaaaaaagcctcggcaaaaaactttaatcggctgcgccgcaaacagtggggcaggcgcttcgtaatcggcttttacgccgcggcgatcaaaagttttcgcccgcctttttcaaaaggcggcgggtgagaaaaaaggcaaggcccctcgtgggtcttgccttttttcgagggcggagccctgaacccgggccgcagccctcataaaagcgcggcccgcaggccgcaagacacccgttcaggcgtagccgcctgccccaagcaaaatccgtgacagacgctgtgcggctggacgcggattttgctccagcccttttgaaaaaaactttccggcttttttgaaaaaagcctcggcaaaaaactttaatctgctgtgccgcaaacagtggggcaggccctgcgtaattagttttgcgccgcgaacagtgggtttggcgctgcgtaaaaataggccgcgccataataaagaaccagaagccaaaaaagaggccgccgcgcaaacgcgcggcggctcgggttatttacagcttgtttttttcagcggcccgtatggccaaaagctggataaaaagggcggccgcggacagcgctatcaaaagctgcgtggccgtaaagggcttaaaataccattcccagtcctgcgtccagccatactgcatgaagcagtatgaagaaacggcagtccaaaccgttccgatgagtgcggcagggcggttatgcgttttgcccgccagcagatacaggatgacataacaaatcagggctgcggcgtaaaaaagaggggtcccataggttaaatcgatgtacatggataaatagagatacgggaccgtgtatccaagcagaaggctgaaacgtaccgcccatcttttcatacgcccttcccccgtgcctgttatttctttttcatctgctcgcgcatacgctgcgaatggtcaaggatggttttgcggatacggatatttttcggcgtgacctcaagcagctcgtcgtcgccgatgaattcgagcgcctcctccagtgagaaccggcgcggcggaatcaggcgcagcgcatcgtccgaacctgaggcacgcgtgtttgtaagctgcttgcgtttacagacgttgaccgcgatatcctcattttttggcgacatgcccacaacctgaccagcatagactggctcgcccgcgccgagaaacagcgtgccgcgctcctgggcgttgtacaggccgtaggtgatcgtttcgcccgtttcaaacgcgatcagagaaccattttgccggcgcggaatttcgcccttgtacggcgcgtaaccataaaacagcgtattcatgacgccctcgccctttgtgtcggtgagaaattcgctcttatagccgaacaggccgcgctccgggatgatgaacaccattttcatgcggctgccgaccgggtccatcgactgcaattcgcccttgcgcggacccatcttttccatgacagcgccggaatattcggccgggacgtcgatggtcagctcctcgaacggctcgcactgttcgccgtcgattgttttatagagcaccttgggcgtgctgacctggaattcatacccttcacggcgcatgttttcaatcaaaattgaaagatgcatttcgccgcggccgcagacaataaacgagtcggctgtatcgccgtcgtttacgcgcaaagatacgtcgcgcagcagctcgcgatagaggcggtcgcggatctgacgcgtcgtaacaaatttgccctcgcgtcccgcgaacgggcttgtattgaccgaaaaggtcatttcaaccgtcggttcggaaatttttacaaacggcagcgcgatatgcgaaccggcggcacaaaccgtatttccgatattgatatcctcaatacccgagaacatgacgatatcgccgactgtagccgactgcacctgtgtgcgtccgacgcctgtgaactggtagatagctgtaattttgccctgttttaacaggtccttatcgtggtaatcgcagacggtgacaggcgcgtttaccttcagttcgccctgttcaatacgcccgattgcgatacgtccgacatattcgttgtaatcgatcgacgagacgagcaccgccgtcggttcatccgggtcgccctcgggcgcatggatataatcgacgattgtatccatcaacggctgaagatcgacgccctgcgtttccggcgaatacgaagcggtgccgtcgcggccggagcagaacaccattgggctgtcaagctgttcgtccgaagcgcccagatccattaaaagttcaagcacctcgtcaacgacctcatagacacgcgcgtcgggccggtcgatcttattgatgacgatgatgacgcccagatcgaggtcgagcgccttgcttaaaacaaagcgtgtctgcggcatgggtccttcggccgcgtcgacgagcagcaatacgccgtcgaccattttgagcacgcgctccacttcgccgccgaagtcggcgtgtcctggcgtatcgacaatattgatcttgacgcccttatattcggcggacgcattctttgccaggatggtaatgccgcgctcgcgttcaatatcgttggagtccatgacgcgctcctgcacggcctgattttcacggaaggttccgctctgcttgagcatgccgtccacaagcgtcgtcttgccgtggtcgacgtgtgcgatgattgcaatatttcttaaatcgccgcgtttgattttcatttgtggctgctccctttttccctgatttaacgatactcatacgacgttatcatagtaccaagtcggcatcttgtcaagaaagggcgcaaaattttgttgacttttcccaatattcggaataaaaaggaacggcggatgcacctgcatccgccgttctggaaaggagtaagtgggaatcaatagtcccagtaatcatcaggcatatccttggtttcacgcgtctcatattcaactgagccgccgtccttggtggtgagctgatcgatcttttccatcagcaggtcatattcaacatcgaaatccttgtcggacactttgagcttactcttgaccgtactctgcttataccacttgccgccctccagaaccttcctgccgttcaggtaaacgtcctcgtcggaatcgcggttaaacatgtattcagtatatttgtcctcccagctgttgcgttttttctcatactgcgattccagccgctcgtcccgttcatcctgcgcttcggaagaaagctggcgcatgacatagctgccgtcgtagaggtagaggttgtcgaacgaaacggtgtcggtgcggttgtagttatagacgccgagcgccaaatacgacggatatacgtccttctgatttgtggaaagcgtgcagttgccaagtttcttttcgttgaggtaataggagatgacgcccttgtcgcacttgatcagcaggctgttccagcccggctcgacttcaagatactcaatttccttgtcgccgttgacgaaggtgcgtgcctggctccagccggttttcgactttgaggtgtaatagacgatatatggcgccttgctgcccatcttctggagcgcgagcgttggagactcgctgatcgcgttgccggagccatccttgagatcgacgcgaaactcggcgcggcggttgttgctgctcgatgagaaccagttgtcatcaacattgatcttgacagtcgcagtccatgtgttcgacgaggtctgggccgccgcgagctttttgccctgcacagcatagtatttatcctgcttgtctgccgggcgcgcggttgtaaagccctttgggccgacggtgatatacagttcgttttcgcttgtgtcaaactcgtccggagcgtagcggtcaacctcccagggtttgtttgacgttttgccgaagctgtcccccgtgatgatcgccaccgccgaaacaggcacggcgaggattgtcacacaggcaagcagcaggctgatcatacccaccagttttttcatgatttgcgttcctccctctctggcggcgcgcggtgcagagccgcacgctgggttcctatatctatatgtataataattataacaaacagtataatgaaaatcaagcaattggcaggcaattttccggcgggagccaaattatattccagcgaaacgaatggttcttggcgtaatctgataaaatagacaaaaacagaggtgaaaatttgtaaatcatgcgtaggaattcaaaaaagcgtgaaatctgttttgaaaatgcttgcaaatcaaaaagaaacggattacactggataaaattaaaatgggtaagaattcgaattttttcactgcaaagggggatatgcaatggagcgggtcatcaagctgctcgtggaatatgacaataggggacgcgagcttgtgcagcaggcgcagcaggcccgcctcgaaacgctggcgcgcctggatgaagataagcgcgcgatacagcagcagatgcgcgcgcacgcggccgagcgtgtcgagcaggtccgccagcaggcccagagggaccgggacgaagccctcgccgggctgcgcgcaaagaatgagcagcggatgcaggcgttgcgccgcgtctatacggcgcgccatgacgagtggctgcgtcagatcgtcggccgctgcatcggcaggtgacggcgatgcagcacagtgaaaacgcagtcgccgccaaggcgcgcgcggcctttgggcggatgctgacgtccagccaatacgatgaattgctgcgcaagcagagcgtgcaggagatttccgcctatctgcgcgagcacaccgcttacgcacaggcgctcgagggcgtgcaggacagcgcgatccatcgcggccgcctggagacgcttttgcggcgcgacttgttttaccagtacgcgcggctgacgcattatgtgcccggcgcgggcgccggcgccatctatggctatattgtgccggatatggagatcgagctgattctgtcggctctgcgcgttatcatttcgggcagcggcgacctgttggcggctctgccgagctttatgcagagctacgcgcgctttgatttggtggcgctggcgcaggcaaaaacgctcgacggactgatcgaggctgtgcgggcgacgccgtatgaggcgatcctgcgcgcctgccgcgagcagtacccgccgcagggcggttcgctgcgcttcacccggtacgaggtggcgctgcgcacatactatttcgagtcgatgcttttacgcgccgcacgcgcgccgaagcacgcggcaaaacagctttcggggctgatcaggatgcgtgcggagctgatgaacctcaacacgatcttccgcatgaaaacgtatttcaatgccgacgcagggcgcatccgcgcgacgctgctcccctatcactggcgtatccgcccgcgtcagatgcaggcgatgatcgaggcgaaggacacgcagacctttatgaagctgctttcgcagaccgcgcttgggcgtcagatcaattcgcaggcggccttcatagagctggaaacggaacgcgtccgttatcacgaaacgctgcggacgctgcgtttcgccacagaaccgcaggtggtttatttggcgtttatgctgctgcgtgcgatggagacggaggacatcatccgtatcatcgagggcgtgcgctaccggctgccgcccgaacggatcggcgccatgcttgcgcgatcctgagagccgcgcaggagcggcctgaaacaatctcttttctgtatttattcgggctttgaaagaattaccgggacgaccggagaaatggaggctggtcatggccattgcaaaaatggcgctcgtgagtattgcgggcgacctcgggcagttggacgacgtgatcatgcaatgtctgggcagcggggcctttcaccccgagccgcctttgcaggccgccgggggaatccggggctttacaccgctcgcggaagaaaatccatatgggcctttgctcgctaaaattaccgacgcgggcgtcgccgccgggctgacgccgcattacgatccgggggctgcgggcgaggcgcttcaggcgcgctactgcgaggatttctgctccgccttccgggaaaagacgacggcgctgcgcgagcggcagaactatctgcacagcgagatcgagcaggatgaatcggggcttgtgatcctttcgcacctggcggagcttgacgtggcgttcgacgaccttttttcctgcaaatatacaaaggtgcgttttggccgccttccgctcgacggggtgcgcaagctcgagtattatgccgaacgtccgtttatatttaaatcgtttgatatagagggcgattaccaatggggggcctattttgttctgacagaaaacgccccggagatcgacgacctgtttttatcgctttactttgaacgggtgcgcgtgcccgaattcatccatgggacgccggaggcggcgcttgagcgcctgcgcgagcaaatcgcgcgcaaccgcgacgcgctggcgcagacaaaaaagcagctcgcggatgtggtgggcgaaaacaacgcggaatttacgcgcatctactcgcggatccggtttctgtcggattcgtttgagctgcggcgcttcgtgtccgtgctgcggcgcgaatatatcgacgtgttttatctgaccggcttcatcgaacaggaccgcgcggccgcgtttgccgcgggaataaaaaagctcgacggagtggatgttgaaatccggccgcatgattcagacaagcgcctgaaggtcccgacaaagctgaaaaacggatggtttgccaagccgtttgagctgtttgtcgagatgtacggcgtaccggcctacggtgacccggacccgacgccgtttgtcgcaatcacctactgcctgttgttcggcgcgatgttcggcgatctgggccagggacttttgctggtgttcggcggatggctgttctggcgcatgaagggcgctgtgcttggacgcataatcaaccgcatcggtattttttcctgcattttcggggcgctttacggttctgtattcggctttgaggagctgttgacgcccttttatacgcaggtgctcggcctgcctggaaagccgattgaggttatggcccctgaaaacaccaaccttgtgcttttgactgctgtcgcgctcggcgtggcgctgatctgcatttccattctgatcggcatttggaccggcttccggcgtcatgattatgaaagtgctgtattttctgcaaacggcattgcggggctgctgttttacggctctattctgttcggcgcggccatgctgtttataaccggcaaaaacctgtttacgccgctttacgttgtcctgctgattgtgctgccgcttgcggcaatcctgttcaaggagccgctgggaaaaatcgtccgtcatatggccgcccgcccggctgagggaatgggcgcgtatctgacggaaggcgcgtttgaattgtttgaggtggttttaagcttcttttccaacacgatgtcgtttctgcgcgtcggaggctttgtattgagccatgcgggcatgatggccgtcgtatttacgctgtctgagatggtcagcggcgcggcaagcccgattgtcatcgtggccggcaatctgtttgtcatcggtatggagggcctgattgtcggcattcaggtgctccgtctggagttttatgaattgttcagccggtattttgacggcgatgggaaaccgtttgtccccgccgccgtgacgccggatgaaagcaaatgaatgtatggaggttcatcaatatgctgtatctgattccaaccgctgcggtcatcgccgcgctcctgctgctgctccccgccagaaaaaaccgtgatacgggccgcgcgcgccgccgccttgttatgaatgcgggcttgtttgttgttgccgccgcgctgatggtcgttatggcggtcggggccgccgccgaagcgcctgaagctgcggccgccgccacagccacagcttcagacgccggccagggcatgggctttttggcggctgcgctggccacgggcctttcgtgtctgggcgcgggcattgcgatcgcgtccactgccccggcggccatcggcgcgttttccgaggaccccaaggcgttcggcaaggcgctgatcttcgtcgtgctgggcgaaggcgtcgcgctctacgggcttttgatctccatcctgctgatcaataagctgtaagccgcgcgccggaatgctttgcgtctgcggcgcagccggtattgacgcagtactcaacccactattcgcggcgcagccgactaaagttttttggcatacctttttttcaaaaaaggtatgaagtttttcgccgaggccttttttcaaaaaggccggaaagttttttgccaagctttttttaaaaaagcggggaaaggtgcttatgaaattttataccttgagcgataatattgacaccatgatggggatgcggcttgccgggatcgagggcgaggtgatccatacgcaggacgaggtgctcgcggcgctgcggcgcgtgatggctgattcggaaatcggcattgtgctgatgacggaaaagttgattgatacctgtcccgctatggtgtaccgctataagctgacgcagaaacgcccgctgatcgtcgaaattcccgaccggcatggcgaaggggatgtgtcgcagaccatcgaaaaatatgtgagtgaggccatcggtgtcaagctgtaagccgcgctgccaacgggaggtgacaggccatgtcagatatacagtccgaaaagctggaatatttcgagcgggagatcatgaaccgcgtacaggctgaaagcgaggcgattcgcgctgaaacgcagcggatgaaggacgaggcgctggaacaggaaaaggcgcgcctttatgacgaattgtataacgatatccaggcacaggtcgcgcagattcgaaaggacactgccggcgagatcgcccatgaaacgcagcagatgaagcatgcgctgtaccggcagcgggagcagtatctctcggagctgcttgccgaggcgcgcgtcgagctggcctcgttttgcaaaagcggcgcgtacagggagtttttgctggggcaggtccgctcgctcgcgcatgactggccgatggagggcagcgtgatcaaggtgcgtgccgacgacctgcgctttgaatccgatatccgcaagctgtatcccggctgtgcagtcgaagccgacgacgcggctgtgccggtcggcggcgttgtgctggtcaacaaggcgcgcggcgtcgagatcgatttgagccttggttcggcgctcgcacagcagaaggactggttttaccataactccaattttatgctggaggacgtctccgcacaggaaggacaggggtgatcgccgatggcgcagaatacggtttattccatcaacgggccggtcgttaaggtcaaggaggccggcgcgctgcaaatgcaggaaaaggtgcttgtcggccataagcgcctgatcggcgaggttatcagcgtcggcagcggcgagacgaccatccaggtttatgagggaaccaccggcatgcgccccggcgaaccggtcgagggaacaggcgggccgatgtgcgcggcgctcgggccgggtatcctttcaaacatctttgacggcatcgaacgcccgctgcgcgaaatcgccgccgcaaacggcgcgttcatcccggcgggcggcgatttgccggcgctcgatatgcagaaaaaatgggacgttgccatgcgcgtccgggagggcgaccggctgacaggcggccagattttcgcggtttgtcccgaaacgtcgatcattgagcaccgcgcaatggtgccgccggggctttccgggacggccgtggatgtcaggccggacggcgcgtatacggccggcgaagcgctgctgacgcttcaggacgacgaagggcaggcgcatccgctttcgcttacgcagttctggccgatccgtgagccgcgtcccgtggcgcgccgcctgccgatcgaccggccgctcatcaccgggcagcgcgtcatcgatacgctgttccctgtcgccaagggcggcacggccgcgatccccggcggctttgggacgggcaagacgatgacgcagcaccagctcgccaagtggagcgatgcggacatcattgtgtacatcggctgcggcgagcgcggcaacgagatgacgcaggtgctcaaggaattcggcgagcttgaggacccaaagagcaaaaaaccgctgaccgaccgcaccgtgctgatcgcaaacacgtcgaacatgccggtcgcggcgcgcgaggcgtcgatctatacaggcatcacgctcgcggagtattaccgcgatatgggctatcatgtcgcgatcatggccgattccacgtcgcgctgggcggaggccctgcgcgagatttccgggcggctggaggaaatgcctgccgaggagggtttcccggcctatctctcgagccgtatttcgcagttttacgagcgcgccggctatatgcagacgctttgcggcgccgaaggttccgtcacgattatcggcgcggtttcaccgcagggcgccgacttttccgagccagtcacgcagaatacaaagcggtttgtccgctgcttctgggcgcttgacaaggcgctcgcctacgcgcgccattatccggccatcaactggacgacaagctacagcgaatacctcgacgacctcgcgccgtggtatgcaaaacatatttcgcccgattttctggcgcgcaggcagcgcgtttcaacattgctgcttgaggaaaacaagctgatggagattgtcaagctgatcggcgaggacgtgctgcccgacgaccagaagcttgtgctggaggccgcgcgcatcatccgcgtcggcctgctccagcaaaacgcctaccaccgcgacgacacctatgtgccgctgcccaagcagatgaagatgatggaggtcatcctctatttttacgataaggccaaagcggttgttgaaaagggtctgcccgtctccgaaattatggaaacgggtctgcccgacaagctggtcaagatcaaatacgatgtgcccaacgaccgccttgacctgttcgacagctattaccgcgagatcgacgaccgcatcgccaagctcgcgcagatgctttgaagggaggcggatggatgttacagtttgtagggcttcatgagatcaacggcccgctggttgtactggacggcgtgccgtccgcctcgtttgaggagatggtttcgctgcgcctgacaagcggcgaaacgcgctttggccgcattgtggagctgatgggcgggcgcgccgtgattcaggtgtttgagggtacgcgcggcatgtcgctggaaaatacaaagacaacgctgcttggccatccgatggagatgccgctttcgcccgaagtgctcggacgcaccttttcaggatccggccgtccaatcgacgggcttggcgagctgttctgcgaacagtccgcggatatcaacgggatgccgatgaatccggtggagcgcgtttacccgcgcaactatatcaacacgggcatctcgtcaatcgacgggctagccacgctgatccgagggcaaaagctgcctatcttctcaggctccggcatgaatcacaataagctcgccgtgcagatggtgcgccaggcgcgcctttccgggccgggcgccgacaattttgtgattgtgttcgcggcgatgggcgttaaaaacgatattgccgactatttccgccggtcgtttgaggacagcggcgtgatggaccgggttgtcatgtttttaaacctgtcaaacgatccgattatcgagcgcatcctgacgccgcgctgtgcgctgactgtggcggaataccttgcgtttgagcgcgggatgcacgtgctggtcatcatgaccgatatcaccgcctactgcgaggcgctgcgcgagttcagctcctccaagggcgaaatccccgggcgcaagggctttccggggtatctgtattccgacctcgcgtcgctttacgagcgcgcgggcatcattgagggcagcggcggttcggtcacacaggtgccgattctcacgatgcccaacgacgatatcacgcacccggtgccagacctcacgggctacatcacggaggggcagatcgtgcttgaccgccagcttgaccagacaggcgtctatccgccggtttcggtgctgccgtcgctgtcgcgcctgatgaaggacggcatcggcgaagggtacacgcgcgccgaccactccgactgctccaaccagctattcgccgcgtattcgcgcgtgcaggacgcgcgcgccctcgcgtctgtcatcggcgaggaggaactgtcccctgccgaccagaaatatatgacattcggacggatgtttgaaaagcattttgtctgccagcggtttgatgagaaccgttccatcgagcagacgctcgatctcggatgggcgctcttgtcgctgctgccgcgcgaggagcttgaccgcgtcgcttcgaacacgcttgagcagttttacaagccggatgaagcagccaagcggttcggcgtctgacacgccggctggtctgcgggaaagggggtaaacatccatgccgaacgaattgaatgtcacgccgaccaagggcagcctgattgctatccagaaatcgctggagctgtcgacgctcggctttgatctgctcgaccgcaagcgcaatattctgattcgggaaatgatgctgctgatcgaccaggtcaaatcgctgcgcggcgagatcagccagacataccgcagcgcctatgaggcgctccaggaagcgaacgtcacgcttggcatcgtgcaggaaacggccatggccgtgccgatcgaggacggtgtgacgatcacctatcgcagcgtcatgggtgttgaaatcccgaatgtgcggttggcggagagcgaaatccgtatgtgctacggctttgaccatacaaattcgcgtctcgattacgcgtatgtctgctttcagaaggcaaagcgcgtcacggcgctgctggccgaggtggaaaacagcgtttatcgccttgccaacgccatccgtaagacgcagcgccgcgcaaacgctctggagaacattgtaatcccgcgctatcgtgagacggcgcgttttatcactgacgcgcttgaggagaaggaccgggaggaattttcgcgcctgaaggttatcaaggcggccaagatgaaaaaagaatgacggacgccgtgcgcccgccgatgtccgcagactgcggacaaaatccggcgggccccggcggtatttttttgttgaaattttttttattttaaagtatagtaaatttgtgcacattcccccaaattcagcgcgtactgccaacaatttaagcgcaggcgcaaattgaccgggtgctgcaaacgtgttaagatagtgtaaatggccgctgtaatgcggttttgtccattatcctatttccctggaaatagaataaacggcgtttgcccgatatgggttttcaaagaggggtgctctatcatggacaggacggactgtgttcgcccgctgactatcggcgtcgacatcggttcgacgacggttaaggttattatcgtaaaagacggcgaagtcgtctatcaacaatatgagcgtcatatgtcgcaggtgcggccaaagacgctggagctgatccgcatggcgcgcgacgttatcggcggccagccggtgcgcgtggcgctttccggttcggcggggcttggcgtcgccaaagcggcgggcctgccgtttatccaggaggtttttgcgaccggcgaagtcatcaaggcgtatgcgcccgacaccgactgcgtcatcgagcttggcggcgaggacgcgaagatcatcttttttaccggcgggcttgaggagcgcatgaacggttcgtgcgccggcgggacgggcgcgttcatcgaccagatggccacgctgctcgacgttacgcccgccgagcttgatacgctcgcgctcggcagcgagaagctctataccatcgcgtcgcgctgcggcgtgtttgcaaaatccgatatacaaccgcttttaaaccagggtgcgcgcaaggaggatatcgccgcctcgatcttcaaggccgtcgtcgatcagacgatcaccggcctggcgcaggggcgccgcatcaccggcaaggtactctttttgggcgggccgctttatttcttcaaggccctgcagcgcgagttcgtgcgctcgctcgggctttcgcccgaaaacgccgtgttccccgatatgggacgctacgccgtcgcactcggcagcgcgctatatgctgaaaaggccgccgatccgctgacatatgacgagcttgtggcgaaaatcgaggatacaacgaacgaaacgcccgcatcgcgccatctgcgcccgctgtttgagaacctcgacgactacgccgcgttttcaaaccgacatgcaaaggcgtccgtggggcgcgccgatctcgatacatacgagggggcggcgtatctcggcgtcgactgcggcagcacgacgacaaagcttgtgctgatcgccggggacggacgaatcctctacgatttttacagcgccaaccgcggcaaccccgtcgagctggtgcgcgcagagcttgagtcgctgctgccgcgctgcggggaccgcattcagatccgcggcggcgcggcgaccggctacggcgaggacctggtgaaaaacgcgtttacgctcgacgcgggccttgtcgagacgatggcgcattttaaggccgcgcgcttttttaaccccgacgtcgacttcatcctcgatatcggcggccaagatatcaagtgcttcaaggtgcgcaacgattcgatcgattcgatcatgctcaacgaggcgtgttcgtcgggctgcggatcgtttatcagcacgttcgcccagtcgatgggctacaacgtcgagcagtttgcaaagctggggctgttcgcgcgctatccggtcgatcttggctcgcgctgcacggtgtttatgaattcttcggtgaagcaggcgcagaaggagggcgcgtccgttgaggacatctccgcgggcatttcgatgtcggttgtgaaaaacgcgatctacaaggtgatccgcgcccattccgccaaggagcttggggagaacatcgtcgtgcagggcggcacgtttttaaacgacgcggtgctgcgcagctttgagatggagctgggacacgacgttgttcgtccgcagatcgccggattgatgggcgcgttcggcgcggcgctttacgcgcgtgagctggaacttgagcagtcggccgtcatcacggccgaggcgcttaagagcttccagcatgagtcgcgttccgctgtctgcggattgtgcggcaaccactgcaacctgacggtcaacacctttggaggcggacgcaaatttatctccggcaaccgctgcgagcgtccgctcggccgcgccgccgccgggacaccggccaacatgtacgcctggaagctgcaaaagctgctctcgcttgcgcctgtgccggggccgcgcgggaaaatcggcctgccgctcgggctgaatatgcttgaaaacctgccgttctggcacgcgtttttgacaaagctcggtttcgaggttgtgaccagcggcgtatcgacgcgcgaaacgtacatcaaggggcagttttccatcccctccgacacggtctgctaccctgccaagctgatgcacgggcatatcgcggatctgctcgagcgcggcgtcaaaacgatcttttatccgtgcatgacgtataactttgacgaggagcgcggcgacaaccacttcaactgcccggttgtcgcttattatcccgagctgctccatgcaaacgtcgcggaattaaacgcgcctgacgtgcactttttgtatccgcatgtcgctgtgcaccgcccgaagaaatttgcggaaaagatccacggcgcgctggcggccgtgttcccggatatcacgcagcgcgaggtgcgcgcggcggccggcgcggcctatgcggcgtatgaccggtggatgcaggacgtaaaggccgagggccggcgtatcatcgatgaggcgcgtgccgccggccgcaggatcattgttctggcgggacggccgtaccacatcgatccggagatcagccacggcatcgacgcgctgatcgcgtcgtttgatatcgctgttgtcagtgaggactgcgtggccgacctggaggagccggtgcgcgtgcacgtcctcaaccagtggacctatcatgcgcggctgtataacgccgctaggtatgtgacgcgtcagccggacatggagctggtgcagctcgtgtcgttcggctgcggcatcgacgccatcacaaccgacgaggtgcgcgccatccttgaggacggcggcaagctgtatacacagcttaaaatcgatgaaatttcaaatctgggcgcggtgaaaatccgtatccgcagtctcctggaggctgttgaggaaaggaggcgggtccatgcctgagcaaaatgacggacgcgtcctttttacaaaggaaatgaaacgcgattatacgatcctggtgccgacgatgctgcccatccacttcaagctgatgatcaacatcctgcgcgaatacggatacaaggccgagcttttggaaaacagcggccagaacgtcgttgacagcggcctgcgcaacgtgcataacgacacctgctaccctgctctgctcgtcattggacagatgatcgacgcgctggagtcgggcaaatacgacctgcacaaagtcgctctgctcatcacacagacaggcggcggctgccgggcttcaaattatatccatctgctgcgcaaggcgctcatgaaaagcggctacggctatattccggtcgtgtctctcagcgccaacggcatggagaaaaaccccggcttcaagctgacgccgatgatgctcgaccgcgtgttttacgcgctcaattacggcgacctgctgatgttgctggccaaccagtgccgcccgtatgaattggagccaggcgcgacggacgcgcttgtggacaagtgggcaaaccgcctgaccggagagatgaaggggcgcgggctgctcagttataagcgtgtgcgccgcaattacgatgcgatcatccgcgacttcgccgccctgccgcgcgagaaaacggaaaaaatccgcgtgggcgtcgtcggggagatctatgtcaagttttcgccgctcggcaacaacaatctggaggagttccttttgtccgagggcgcggaggtcgttgtccccggactgcttgacttttgcctttactgcgtctataaccagctcaacgaccacaagctctacggcctgatgagcgcggccaagacgtttgtgctgcgcatggtatacaacatgctggtgaaaaaacagcgcgacgtcatcgacgcggtcaacgccgaaggcaccttccgtcccggcggatactttccgcatacggtggagctggtgcgcggctacatcagccacggcgtcaaaatgggcgagggctggcttctgaccgccgagatgctcgagctgatcgagcagggcgcgggaaatatcgtctgcacacagccgttcggctgcctgccgaaccatatcgtcggcaaagggatgatgcgcgttatcaaggagcgcaacccgcagtcgaatattgtggcggttgattacgatcccggcgccacaaagatcaatcaggaaaaccgcatcaagttgatgctggcaaacgctgcgtccatcgcggagcaggccggggcaggcaaaacggtcccgatgccgcagcatgaaaacgagtatgacagcgcgaatacgcccgtacataacccgtttctcaacccgacgtccacatcgagcagccggaattaaatcttgaaaaaaaggccccgcgccagccctgaaagggcggcgcggggcttttttcgggttttatccggcagcggcggctgccggtcacgtctggggccgcgcgcattcaaaggcagtgcccttgaggatacgcacgccgtggccgagcgccggcaggatgcatgccaggctttcgcggacagcgcgcgggctgccgggaaggtttacgatcagcgtgccgccccggatgacggacgcgccgcggctgagcatcgcgcggtcggtgtggcgcgccgactcggcgcggattgcctcggcgatgcccggcgcattgcgtgtagcgacggcgagcgttgcctcgggcgtacagtcgcgcgcggaaaaaccggtcccgcccgttgtgacgacaaggtcagcttggcgtccgtcggaaagccggatcagctccgtctcgatgcgcttttgctcatccggcaggatcagcgtttcaatgatttcatagccggcctgctcaagcagctcaacagccgcagggccgctttcgtcgacgcgttggcccgcagcgcccttgtcgctgagggtgacgacggcggcgcgcagcggcgcgtcggccgccggcgggatagctgtcatctcgtcgccgacagagatggtcccgccgtgcagcacgcgcgcgaacacgccctcgcgcggcatgatacagtcccccatcttgtgatagatctgacagtgggagtggcattccttgccgatctgtgtcatttccaaaagcacgtcgccgcattgaaaccgtgtgccgaccggcaggcttcggaaatcaaagccctccacgaccaggttttcaccaaacgccccggggccgacatccgcgccgcggcgtttaaattcctcgattttgtcgtaagaaagcaggctcacctggcggtgccatgtcccgcggtgcgcgtcgttgacgatgccgcagtccggcgcgaaggttgccgcgcccacatcgattttctggatgccgcgccggtcgctgatgcagacagctctgacaattcccatatggatcaccctcctatttgtgacatgccgcgcgattcctcggcggcctggcctggtataaacgcatgcgcgcgcggttttttcagaatagcgcggctcatcgccccggcgatctcgtcgtcattcgcgccgccgcgcaacagcgcgcgcagatccgcgccgtcatcatgataaaggcagagcttaaaaaacccctcgcttgtcagccgcacccggttgcagccggtgcaaaagctgtgcgaaacggcttcgataaagccgatggaacctttcagagcgccgctggtgaaataacgcgccgggccaaatccatgcttttttgggtcgggcgttaaatctggaaaagcctcgcgcacgtgtgtgcgcaccgtctcagccggcaccggctccatggagccgcccaaaccgatcggcatcatttcaataaagcgcacgtcaaccggccagtcgcgcgcaagcatggccaggctgcacagctcgtcctcgttgacgccggaaagcggtacgcagttgatcttgacgcacagcccggcgtcgacagccgcgcacagcccgcgccatacagcgtcaaaactgtcgcgcccggtgattttggcgtaaacatctggccgcagcgtatccaggctgatgttgactccgtccacgccgatttcacgaaaacgcggtacaacctcctcgagcaacacgccgttagtcgtgactgtgacatgctcgatgccgggcagcgccttgatctgttcgatcagctcacagcagccgcgccgcacaagcggttcgcctccggtaattttgatattgcgcacgcccagctttgttgcggcgcggcagatacggatgatttcctcatagcgcaggatttgatcgtgctcaataaacggctggtcctccggcatacaataccggcagcgcagattgcatcggtccgtgatggatacgcgcatataatcgatacgtcgtccgcaggaatcaatcatgttttttacctcccttttggcgcgcgcaatccgtgcgcggattgcccaccgccggccgctttgcttgcccggccggctattcggggctttccggcgctatagcgccgggcgcggacaagccgcggctgcgccccttttcgcgcctcacaaggggcgggtcggcgaccctccccttatgttatccccgcctctgcttggcacagatttttcgggcgcacgccggtgtgttctgtgataaatcatcaagccccgcgaaggcgtcggatgccatagcggacgatgccgctgtgacccgcgcacgggtcacgcgcgccagaaaggccggatcagacattgcgggcgcgcacggcgcggccaagcaaaatatagaccgtggcgaacagcggcacgcccaaaatcataccggcaatgccgaacaggttgccgcccacggtgacggcgaacagcacccaaagcggcggcaggccgaccgaaccgccgatcactttgggtgcgataatattgccgtcgacctgctggacaatcacgacaaacagaatataccagattgctttgatcgggtcggccatcaagaggatgagtacccctgggaccgctccgatgaacggcccgaaaaacggaatcacatttgtgacgcccatgacgacgccgatcagcacagcatatggaaaacgcagcaccgacaggccgatcacgctgaccgcgccgacgatcagcgcgtcaagcgcctggccgctgacatagcggcggaaggtgccggccgcgacagacgcggcgctggcaatgctgtccgcggcctttggcggcagaaacgcccgattgagccgccgtgcctgtgaaagaagctgctcctttgtgagcaggacatggatggagacgatcacgccaatgacgagcgttacaataccgcccccgaaggacgcggcgaaattgagcgcatacggcacaaattcggcgatgaagttgagcagaaaatcagccagacctgacagccagccggtaagctgctcgtaaaattcgggcggcagtacccattcgtgctgaaagcgggctgcaagctcggcaagcgagttgagataagccgggatattgcggccgagcgtgatggcgctttcaccgagctgagggacgaccgtccagccgagcaccaccagtgccgccaggaccagcagataggtgctgatcaacgaaagcggtcgtacaagaccggcgcgccgtggaaaacggcgaggcaaatcggcgaacacatgcttttcaaacgtttccatcacgccgttgaggacaaatgccaggaccacaccaatgaaaaacggcataagcaggcgaacagacgccgaagcaacctgtcccacgcgttccggatggctcaggacaaagtaaagcacgacggtaaacgcagcgacggtacaatatcccttgatttgttttttgtccaatcaatcacctctgggcggcagtgtcctgccgctttaatagtgttccctccgacacaatgacgccgagcagaatcaatatggcgcctgcgatcatcagcggcgtgatgcgctcatgcagtacgatgacggaagcgatcattgtgatgagggggtttaaatagacgaaattgttggaacgcaccgctccaagccctgcgacgacataattccaaagcacataacacagcgacgatgcgatcagccctaaaaacagcagattgccgaggatcagcggctccttcagcacggccatatcaaatggcgcggcgtcaaacagcagacatggcagcatcgtcaaaatggaataaaaaaagatgcgccgcgtgacatatacaggcgggtagctggagcggataccgcgcagaattacagaataaaaggcccaggagagcgcggcggcgaccgcgagcaggtcgccttttggcgataacttgagcacaaagctgccgttgaagacaacgagcgcaatcccagtcatggcaacaaaaaaaccgccgaccgcatttcgcgtcaggtgttcgtcacgagtggtcagatgcgcaacgatcgacgtgagaatcggcgccgcggagatcagcaggctgacattggccgcctgggtaaaggaaagcgcaaagttttccgccagaaagtaaagcgtgctgccgaacagggcggccgcgacatagcgaaactccagggagaggctttccggccggtggatttttggatgaattgcaagcagcgacacatacgcgatcacatagcgcaaaagcatgatgtgaataggcgaaagcacacccagcaggattttggttgaaacaaaggttgtcccccaaaaacagatggtaacaagcgcaaggataatataaagccgttctcgtttcatgcgctgcgctccgagccttccgtatgcgccgcgggtgcggaagcgctgaaattttgccaaaagccgctgccagaaaacgcttcgcgaagctgaaagaataaaaatgttccgatcagcaacaatgccgcggctgcccctgcgatcactctgcggattgtgcgctttcgtgcgcgtccctgctccctccgcatctggcgaagcttgtcaaagtctacaacccttttttccggatcatgatcgtgcattgcaaaatacctctcagaggccgcgcggcagcggcccgtttttaattagtataccacagcggcaagcccgttcaggcttgtctaccgcgaagcggcatgggataattgcccatcaaaaggcggttgccgcgtaagcggcgagccgttgggcataaccccggtataataaccgctctgcggttattataccacagcggcaagcccaaaagggcttggctgccgcaaagcggcagctaaaccagcagagctggttttggatgtggtgtaacatgcgcagtccgccgctttgcagcggcagccgccagatggcggctgcaaacggcgtagccgtttgccctgcgcatattataccacatactttttttgaaaaaaaggtatgccccaaaactttagccggtttctccgaagcctatttgaaaaaaggcttcggagaaaaaccttattcggctgagccgcaaacagcgggttaggcgccgcgcttatacaggccgcaccgcgaaggatacggcagacggcggacgcgccttacagggaagccttgtcgtaacagatcagcgacgtgcggttgggcaggcacacggcgcggtcgccggggttttgacaccagcctgtttgctcacagaggtggtcgggacaggtgacgtcgataaaacggatgcgtccatcccgcacctcaaaggaaaccggcctgccagtttcctcctcaatccggaaggtatacgcttcaccggccgacaagtcgacgcggcgcagctcgtctccgtctacagagataaccgcaactacgccgccggccgcctcttttgggcggtaaagaaaaaaagcagccgcgatacaggccgccagcagcaccgcaacaataatccattcccgtttcttcataataaacgcgccgccagtccggcgtagtcgatggtttcaagatggatacaacgtatgcgctcggagatattgcccagatcgtgagcgtcggaacttgtaacgaccgtatagccctcctgaagatcgctgtgcgcaccgccggcaaaaaagcgttccggatgtgcgacttcaaggatatgaaagccgcattccggcgggatgccccccaggtttgacagaacgctgttgcttggccggtcgatgtgcgctggaaaacacagcccgcaaaactgcgctacggccgcaggcgcttcatcgatactgatcgaggtcgcattgacgagcaaaaggtcctcgtgaccgatcggatcgtcatttttatccaggataagctgttcgccaaagatgtccggcgcgtttttgacaggcgccaggcgttcgtggacaaaggcgtcgaacgccattgcattgtcaagcgccggaaacagacaaacgacatgcgcctcctccgcggtggtcagctccatgcccggcagtacgacaagtcctgtgccggctgccgccttcataattgccggacagtttttacaggagttgtgatcggtcagtgcgatcagctcaagctctttgagcagcgccatattcacaatattattcggcgtcatatcctgatcgccgcagggcgacagacacgagtgaatatgcaaatcataaaacacaggacgcatggccgcttcccccctttttccgcagcgggcggcccgccgtcagcgattgagcaaagtatagatcgcaagacacgtttcaaataccggatcgctgctgcgcaatacggcgatatcgttctgttcggccttggcgcgcgcatcgtcgtcgagcgccgcgccctcggcgagcacgacgcacgcaacatccgccagcacagcgaccgccatcgcgttgacattgcccatcaccgtcgcccatgcgctgtcggcgggcgcgcggcccataacaaacgaaagcaggtcgcaggagtaaacgctttgaatcgggcggtcgagcgcgccgccgccggtcagaatttcaaaatgcagaatatccgcagtttcacggactgtcatgatcaggccccctatcttgatttgtcaccgtccgccttcggcattacgcgtgaaagtcggcgcaggctttccgccatgccgtcgatctcctcgcgcagcttaaagatacatgcttcctcagtggcaaagccccgtacaatatcctcagcgagcgccttgcacgacggcgcgccgcaggaaccgcagtccatgccgtataagcgcgcttcaatttcgcgcatggttttcattttttccatcgccgtgcggaaatcggcgtcaagctccaatacaggctcatactcaaccgcctcgtcccagaaaaaggcggagagatcctccccgtcgatatggttgcacgacacagggcggtatttgcggatacgcttgagcttggccctggcgacatacgggttttcaaccgtgagcacgccgccgacacagccgccggagcaggcgttcagttccacaaaatcgaggtcgtaaaatttttcgtcctccaaatcctccagcacccggatgacattttcaatcccatccgccgcgagataccgctccttgagcgcggcggcggcttcaccgccgctgctgccccatccgatccccatacgccctgtacgcgccaaatcgaccgaactggggacctcgcgcatgaggctgatcagtttgggatagacctcgcggatggccagaacgccgtcgacacagctcttttcagagccaagcggcattttgacagccgtcaccttggccgggcatgggctgataaagatcgcgccgatctgctcgggcggcaggcccgtcttttcagcggcatgctttttagccagacgcgctgcgacctcaatcggggcgtgcatcggcagaacgtgtccgatcagctcgggaaaacgcacgcggatcaggcggagcacagccggacaggcagagcttaccacagggcgcaggatatcctccctggccatgtagcgcctggtcgcgtcggagacaagctcggcggcgcgcgcgacctcaaacacctcgtcaaagcccatcagcagcaacgcgccgagaatgagatcgatatcgtcaaggttgttgaactgcccatagagcgcgggcgcgggcagcgcaattttataggtgaagcggtccataacagacagcgggtcaaaaattgcctgtttggcatgatgcggacagacgcggatacattcgccgcaatcgatacaccgctccttgatgattttggccttgccgccgcgcacgcggatcgcctcggtgggacagcgtttgacacagttgatgcagccgtgacatttgtcgcggtcgagcgttacggagtgaaaaaaattcgccgtatccatgcggacggcctcccttcagttgggtgtaaaaagggactgattgagctgttaatcaagcgatccgcaccatcatattgacggttgtgccttcgccgggcgcgctgatgatctccattttatcggaatattttttcatgttgggaagtcccatccccgcgccgaacccaagattgcgaacctcctcgggcgcggtggaccagccctcctgcatcgcaagggcgatatcggggataccggggccatgatcagaaagagacatgcggatatcctcgctgccgatttcaactgcgatctgtccgccgcctccatgaatgaccatattgatttcgccttcatacatggcaatggcaaccttgcgcacgacagccggggaaagccccagctttttaagcactcccttgacatcgctggaggcttcacctgcgcgtgtgaaatcgtcgcccggcacgttgtacgtcaatttaattgattcagacatccgtttcacagccacccttcagcccgttttcataaagcagcccgcaggctgtgaacatgcggtagggcgaggtcatgacggcgatgccgcgctgctgcgccagacggataattgcgtcgtccgggcgtttgccgcgtataaaaacaatacaaagcatatccatcatctcagcggtgcgcaccacctgagcattgacaagccccgtcagaaggacgctctgatccttgacatatgcaagcacgtcgctcatcatatcgctgccgcaggccgtgtgcacctgggcgtcgaggtgatcgccttcgcacagcaaatctgcgcgcagaattttttggatatcgcgtacagtcatagataccctccttgtcaaaagccctgcttttttgaaaaaaagcttggcaaaaaactttagccggctgcgccgcggacagtggggcgggcgccgcgtttatgcaggctgcgccgcgaacctggtccggccgccgtcatcggtcatgtgtctgttttttaacaaaacagacgaaaaccgcgtgcccttggagtgcgaaattatgtaagttttagtataccatatcacgttatgttacgcaacagtccagttttgagcggttctgacggagtctgtatggcgtatgtaaaaaagagggcaaaacataagggttttcggttacaaggaagtatattttttaatttggcggtatagccccgttcaagggctatgccgtcttttcctgtttattggcttctttctgttctgtctgcgggtcagtcagcaaatgaatttctcccacaaagttaaagacaatatctactttctgaaaacgcttgccgtctatcttctccggtgcatggacaacgatttttttaataaattcattgacgatagtgggcgttaattcggttattcccacatacttgcggataatggcagcgaagctgtcaaagtcacttttattctgttcgtaggtatccacttcctgttgttctgcctttaccttttctgtaagttctttctgctctgcttcatactctgcggacaacttcaaaaaccgctcatggctgattgtgccgttgatgtcgtcctcataaatccgcttgaaaatccggtcaagttccgcaatccgttttcttgcctgtccgacctcacgccgtttgcgtttcatgtccttttccgcttcatcgaatcgctgtttctgtatcaattccataaaagcagtgatgtcctcatagaacatggcagttacggcaaatatccggttgagaacgattttccgcaagacttcttctctgatgaagtgtgccgtacaatctcctgtattgcttttatatcttgcacagcggtagttgtcttgtgaaccgtcaaagctcttgcaggtggcaaagtgcagtttacttccacaatccgcacagaataccaagccggaaaacattccctgccgctctgcctttgtggggcggcgtttatttgcccttaattcctgtacccgttcaaagacagcttcctcaacgattgcttcatgggtgttgcggaaaatcgcctgctgttcctttgtggtgggaatacgctttttcagcttgtgggatttggaatagcttttgaagtttaccgtatgcccacaatagtccatacgctctaaaaccgctgcaatcgtactttcattccaactgtacggattatcgggaatggattttcctttctgctttgcataatgggcgcgtgttgtcagcactttgtcagctttcagtattttcgctatccgcataggtccgtttccggcaacacataaatcaaaaatcctctttaccacagcggcggcttcttcatctacaatccatttctttctgtcgtttgggtctaccttatagccataaggcggcttagtcagatgttcccctgccatgccctgcgctttcttgattgcccgtacctttttactggtatctttggcgtaaaaatcgttaaacagatttcggaaaggggtaaaatcattgtcgccctttgcactgtccacgccgtcattgattgcgatatagcgcacatctctttcaacgaaaaagatttctgtatagtagccgactttcagatagtcacgccccaagcgggacatatccttgacaatgactgtcgccacatttccggcttcaatctctacaatcatgcggttaaaattcgggcggtcaaaggtcacaccggaaacgccgtcatcaatgaaaaatactggatttgtaaagccattatccgaagcgtattttgacataactgctttctgactatcaatgctgttactatccccgtccaatgcgtcctcttgacttaaacgggtatataatgcggttatctgttcgggtttatagttctgtttgtgtagaagatgtagacgaaaatgagatatttgtaattgatagaatattaattattgtttaaaaaaagtggctttactatcgggcggcaggaaataaatcaagctgaagaatatattgatgcgatttataaaggtaacaagctaaactgcaaaccaaaaatcaaagcctttgttgttggtgattcggtgtctccatccataagcacaaaaaaactcaagaggattatggagaagtttatgcctatacttataagcaattagtgcaaatggctgtaaaaagacttttcaatttaaaagataagctaactgtaagctatcaggagctaaatgctaaagactacttagccgagattttgggtgagcctcgtcagatgaatttgactatttcagaataattaataaaatacggacgcaccacgctttgataaaatggtgtgtccgtatttttaatcctgtatggcagctgccctatttcagtttgttaattgatactattttatgcgtagctaccctggggacgttctttttatatgcactctatatcaaaaccgcttgccgcgggaaaaacttggactgccctgcccgccggaccggtattccgcccatccggcgggccgacatgtgaaaaaagaggtagaagaaaagagagagaaagtaatgaataaaggctggagaatgtctttactttttatcctggaggatacaccgcctttccttttggagtggtttcagtataccggccgaatgtgaaatccgtttgaagtttttttgacggttgcttaaaacttccatggataaaatgcgaaaggcccccgccgttatggcagggacccttcgcgttgatatgggaaagaagaagtaagtcggcggtcaattttttgcgggctgcgtttcggctgggtccttgagaaccatgtgcagaaggatgttgagtacgacgccgcagacaaccgcgataaacacgttgttgttgacaaacatcttgacaaacgggtggaaggaattggcccactccgcgcctgtggtggagaaaaacacaggcagcatcaccgctgtgccgatggtggtcccggcgatcaggttgttgcgggcgtcgcgcgcttcggaaacgacaacgtcgatgccggagaacatgatcatactcgcagagatcaggaacacagcgccaacgaccggacgcggaatgcaggcgagcatctgcgcaagctttggagacaagccgtaaagcaggaacataaccgccgccacccgcacaacgcggcgggacgcgacgcctgtagcggccagaatgccgatgttctgcgtataacttgtgaccggcagcgcaccgagcagtccggaaccgatgcagccgagtccctcggccatgatgcccttgttgatatgcttgacgcggtaaacctgatcgcagaccgcacaggtggcggcataatcgccgattgattcaaagatcgagccgatatagccggtaaagcccgccaggatcgcggccgggatcagcacaaacggcgcggtcgccccttcaaagttgcggaacgggaaaagctgcggcagggcaaacaggtcggcctgaccgacaagctcccagtcgaagataccagcgaccgatgaaacaacgatgccgacgatcacaaccgaaatcagaacgaagccctgggacagcagccccttacagcggaatttaagcacaagcgccaacaaaaaggcaaccaacgccagaatcaggtagaccggctcatgcgaagcgaatatccaacccagggctattttagccgcaacaaagccgatcgtcgctacgaccgacccggtcacgacaggggggatgaatttgcgcaggcgtcccagtatacgggaaacgccgatgactgcttcaagcgcgccgccgacaagcacagcaccccacattgcggggaacccgtaggtggccgcgacgccgcccatcgcggtcaaaacggacgaggacggtccctgtacaaccggcaggcggtttccaatggtcgtctggagcagagtgcctacgcccatggcaagaaaacaggtgcggatcataatcgggagtatcgtttcagatagacctgccagcgatacaaacattccggcccagataaacggtgtgaagtcgacaagcgtaatctgccatgcaaaaaagagggtctgccaccagctcttggggttttcatcgactccgatcgtcacctttaccgtgctgtccggctgtttatcaaaaataggctgctcaggattatacattgcttttccctcctccggttgggcagccgtccggcagcggacggctgcggtttacacctgatggttacagcagtgaagccttgcgttcaaacgaagcgatcacgcggccgcggcgcaggatgtacggacgcgacgcgcgcgtgcgcagcgcctcctgaatattgtccgcatcgagcaggttgaggtctgcgtcgtttccgacctcgatgccatattttgcgcccggatcaaatattttggcggagttataggtgagcatatcaaagatcaatttcgcggtgcccggtgtattatactgtgcggtgtacgcgcctacaaggccgtaatcgagcggatcgcccgtgccgtacagatggaatccgtcgcagatcgtgtcctgcgcggtggcgacattaatgcccatatcgaccatctcgcggatgcgtgtgacgccgcgcgtgcgcggttcggcgtcgatgcccatgatggcaagcacctgcgtattggtgcagatattcatacctgactccttgatcagcttcataaccttgatcgcgtgcgactggttttgataggtgatcgatgtacagtgtccgcctgtgacgcgcggtccccatcccttctgcatggtcagccatgccgtatattcaagcgagcggtcaaacatgtccttggactggtcgatgtgcatatcgatcgggacattgtatttttcagcgatttcaaataccaggtccacatggctacgcgcgtgttcgtcgagccattcggccgcaggcatgccgcccaccacatcgcagcccatctccatggcctgccacatcagcttttcggtgccctcattggcataaataccctcctgcgggaaggcgatgacctgcaaatcgcagatgtccttgcaggcttcctttgcggccagcacaccctcaaggccgaccaggtttgccatattatcaatgtccacgttcgtgcgcagctttgtcgtgccgtacatgacacactcacggatggcccgctcggcgcgcgccttcacatcttcgacggtgtagcgccgcttgatgtcgtgcatgatatggatggaatcctccagcgtttcgacggtactttcacggccggcgagcgcggtgtatgccttgtcaaaatgcatatgtgtgttgacaaacgtcggtgcggccagcataccattggcatcgatcacctcaagcccttcgatgccttcggaattgatgccgggtcggatttcagcatatttgccgtcgtccccgatcagaaggtcgttcataccgcgtccatccgcaagattcgcattgcgtatcaagagcatggcgtccactccttttctattttgttttgctttggaatgactccatcatagcaatccgtcattgcgatgtcaaattttttatgttaaaattgcacgtaattttatccttaaaacaacacttttttgccaaaaacaacttattaattgcgcaattaagaaagcctttgtttacatttcattttaattgctgtaaaataaatacaaaaaatatgcttatccctaaaaaaatctgatttttacagcgtcttatgattgacaggcaagaccatgcggaatataaaacgcttttacgcacggcttgaggctcaaggagggtgtgaagcaatgatcacgattcatgatgtagcagccgcctgcggcgtctccgccacaacggtttcacacgtgctgaaccatacgcgccctgtcgacccgcagacggccgcccgggtgcgggcagccgtcgaaacgcttgggtaccggccgctgcgcaaccgcgacaaatacggactgcgcgcctcccgcaccgtcggcttttttgcccacggcgctggaatcactgcctgcgccgacctgcttgaacgcctgcgcggccaggtgggtgcacaatgccgtctgatgctgatctgcacagagcaatcgctgtccgacggtgaattgcgagccatgcaaatgttttaccgcctgtcgctgtgcatcctgcacaactctgtccgcatcagcggcgcgggcgtgtcctcggacgcctatccggttcccacgctgctgttaagcagccagccggcggacgcgcccaacctgcgctgcatttcgtttgattaccgccgcgcagcgcagatggcgctttcgcatctgatcggccttggacataccgaaaccgcatttctatccagtatgcacaacagcacggtcaatgatgaaatccgcgattctgtccgtgcttttctgcgcgagcatgggcttgcctttcgggaggattattatttcgagcttcccaccacgcccggtacagcgtccacacaggcagcgctcgactcgtttttcacatcccatccctccctgacggcggtgattccagtcggcgcgtgggcagcggcctgtatagccgattattttctgcggcgcgagctgtccagcccgcgcgacaaatcaatcgtcgccatcggtgggctgagtatcctggaggaatacagctcgcatatcacacgcgtcgatatgggcacagacagcctgctcgccgcgattgccgcctggatcgacgcgcagggcgcccgggacatccccgcgcgaatcgcgcccgtgttccatccgggcgccagcacacggacgctcgcccgcacaccggctggcgcgcccgcctttgcacccgagacgctggagctttcgtccgacgaattgcagcgggtgcgcgccggaagctttaccgtctgcgtctcgcttgacaacggcgacgcggcctttttccagctcgtgctgcgcggcctgcgcgacgccctcaccgatctgaatatgacgctgcttgaaacggctgaagcgcacggcagccttgcgcggcgcggctcgcagctgaagtatttcgcccatctctcgcccgatgcgatcatcagcttttcaaatgaccagacgcctttgcgcgatcaattcgtcgcactggccaacagccggtccaagctcattctgggcgtcgacatgccgcccgatctgccggaatatgcctgcgcgtcctgcgtcgccaccaacgagccggaaaaaggccggctggcgggacgtctgctcgcctccgagctaattcgacgcaaaaggcgccgcgtcggctttatctgcaacgcagacgtgaatttctgcgcgcgtcagcgcgacctggctgctatcagtacggtgcgcgaggattttccgcagctcgagatcgtctttcgccatgattttcttaacgagcgccaagccgcggacgctgtgcgccaggcacttgacgcatatcccgatgtggacggcgtctatatcttttccgcgcgcgccgctcttgaggcacagcggctgctgctcgcacgcggccgcggcgacgtgctgcttgtcaccacccagatcaatgccgaaatcgccggtatgctgattgaatatccgaatctgcttgggatcatctcctcgcagggctatgaaatcggccgctgccttgcgcttgcggccgccgtcagcctgattggaaagcagccgccgcgctatgtggcgctcgatcccgtcaccattaccgccggaaatctggagcgcgcctgggtgcgcacggcgcgtttaagtccgccggcgcagtaagaagcccggacgcgcgcggcgcgtccgggctgtttgtttgaggaagggctcctacgcctgcttattggatgtgcgcagcagtgttcggtatttatacgcaaacagcaggcagcaggttgtcgcggccgtgatatccgcgattggttcggccagaacaaccccatccgtggccggcgttatgaaatgcggcaggatgataacaagcggaatcagcaggatcagcttgcgcagcaacgcaataaaaatcgacaccttcgcctgtccaagagcgataaacacttgctgcaaggccaattgtacgccgaaaatagccatccccagaaaaaagaccggcatgatctgcgcggccagctccacaacggccgggtcgtcggtaaagacgcgcacaggaagctttggaaaaaacaccgcgacaccccacagcagcagactgaacgccaggcagaataccgcgcagtactttgcagccgacttcacacggtcataattgcccgcgccgtaattaaagccgatgattggctgcgcgccctgtgcaaaccccataaccggcatcgtaaaaaactgcattacgctggacatgatgacgatggcgctcacatacaaatcgccgccatacgactgcatcgacgtattaaaggcgatctgcacaaggctctccgtgctctgcatgataaacggcgacagccccagtgcaagcacacttgccatcacacgcgggctgatgcgcagatactgaacgcgcaggcgcagcgtgctccgcgtggaacagacaaaccacagcacccaggctgcggaaaccgtctgtgaaataaccgtcgcgagcgccgcgccgcgcacacccatatcgcaggcgaaaattaaaatgggatccagaatgatattgagcgcagcgccgacacagaccgtcgccatcgctgttttcgcaaagccctgcgccgatatgaactgatttaagccgagcgccagttggacgctgatggtcccgatcagatagacgctcagataactgtccgcataggggagcgtatcgtcgctcgcgccgaacagacgcagcagcggcgtcttaaaaagcagaagcagcgtcgtaagaaccagcgcgagcaaaacaagcatggaaaagcagtttcccagcagccgctgcgcttccgcgcgcttgccggcgcccatgcggatggaggcgagcggcgcgccgccaaagcccaccagggctgcaaacgccgaaataatcatgatgatcggaaaggtcagccccacgcctgtcaaagccattgtccccgtcaccggaatgcggccgatatacatgcggtcgacgacgttataaagcgcgttgatgatttgtgcggcgatggccggcgcggaaagcgacagaatcaacctggggatgttctcattggcaaatcgttcgtccatggactgcttcaatgctgttcacccgttcgtacaaagtcatactaacattttatctatcttatcacaaaagtatgaacagattatgtatgcacacaatatcagtgactgctgcatttcccgggaaaaaggtatgctgaaaaactttagccggctgcgcgccggcctttttgaaaaaaggcctcggcgaaaaactttagtcggctgcgccgcgaacagtggggtgggttctgatatttatactggctgcgccgcgaacagtggggcgggttctgatatttatactggctgcgccgcgaacagtggggcggggtctgatatttatactggctgcgccgcgaacagtggggcggggtctgatatttatactggctgcgccgcgaacagcggggcagccgctgcataaagacaggctgctttcatccggcgttcagccgtcgatgtggatgttgacgccgttgacctcgacgccgtcgttggcgcggatcaggatgtatttgcatccattgatgacgcgcgtttcgaccaggtcgctgcgctgcgggttcacatggatggtaacgtcgggcgtgcgcacctcgaactgcttctggtcgacgatgttgcgcggcggcaaatccgtatcggcgccgaacgcgtcgtcataccgcgcgtcaaacgcttctatgttttcctcggaaacgccgcaggactttaaaacgttcttgaccgtgtactttgaaacggcaagcggctcgtccacatggttcgccttatgctcctcgatcatcccgcagagctgctcgtgaaccgtctgcatgacgccaaggctgcaatcgccttcgagcgtatcctccagaatttcctggaacgtctccttctgaacggcggccgccatcggcagtgggcggcagaacaccgcgtccacaaaatcctgattcatctgttccgtatcgcgtgaataataaagcgcgccgtacaggtttgcgctgcggtcgtcaaacgccgggaacagaaagccaagctcgggtgcggcgacaatccaatccgccttgcagttgcggaatgtattttcattgacataatagcttaaggcgggctttgtcatcttgaccgggcaaacgctgcaaagaatgtaagaatacacctcggccgccgcatcgtcaagctgttgtccgtccttggcgcgatagggaacgtcatatgtatcgtgcgccaacaggatcaggtaatttccgtcaaacgaaaccgcctgtatgacgtgttcataaaattcgcgcaccgcctgttcatcgcaaagcgaggaacttcgcagcgccatcagcaggcggtgctccgggctgtcaaccacctgctgcgttgcaaacgcgatatcgatcagatttttcccaagcccgcctgacagcgtccgcttgaggatggcgagcagcttttcggcctcctcctgcggcatcagggcgagcgactgtgaaaattcagagacaatctcccgtttttcgttgatataacagccccgcacatgggtgatgttgcttttgtccggtttaaaccggcggcggatttccgcaatttccttctcgttcatacgatcctctttccgtaataagctttattggttcggtctgttttacagcaacattcagggcggcagcgggccgcgcccgcgtatcgccctggccatggaagtaaaatagccgctctgcggttattttagcatgtccgcaaagcggcatgataaaattggccttcagggcggcagcgggccgcgcccgcgtatcgccctggccatggaagaaaaataaccgctctgcggttattttagcacaaatatccctccgcaacaaaccgaaaaaaggcagcccctgtatccctgcccaatggaacaggcttatctttgtagaaacgcacaaaatttcccgggaatgcttgcattgcctgtattggggttgtatcataattttatcgttgcggcccacgccgcggcgcagggtgtggcagatacgccgtgagggctgttttgccatgcttttttgttatgatagaaacggcgccgcccattcgtggcgaagcgctacggagggaatggatacgggcaaatatattctggcgctcgaccagggcaccaccagctcgcgcgcgatcctgttcgatcatgagcagaatattgcaggcatcgcgcagaaagaatttacgcagctttacccaaggcaggggtgggtcgaacacgatcccatggagatttacgcctcgcagtatgcggtgatgatggaggtcatcgcccagacgggcgtgaacgcgcgcgatatctctgccatcggcgtcaccaaccagcgtgaaaccacgattctttgggaccggcagacaggccgcccgatctataacgcgatcgtctggcagtgccggcgcacagccggtatcatcgacgcattaaaggaaaagggcctgtccggttacatccgggagacgacgggcctggtcccggacgcttacttttccgggaccaagatcaaatggattctggatcagacgccgggcgcgcgcgttcgcgcgcgcaggggcgaaatcctgttcggtacggtggatagctggctggtctggaaactgaccggcggcgcggcgcatgtaaccgattatacaaacgcctcgcgcacaatgatctataatatcaacacgctcgattgggacgatcgcctgctggacgcgctcgacatcccccgcgcaatgctgcccgccgtctgcgacagcagccgtatctatgggtatgcagaaatccagggcgcgcgcattccgattgcgggtatcgccggcgatcagcaggcggcgctgtttgggcaatgctgctttaagcagggggaagcgaaaaacacctatgggaccggctgctttttgctgatgaacaccggcgaaacgccctgtatcagcgataacggcctggtcacaacaatcgcggccggactgggcggccgggtacagtacgcgctggaggggagcgttttcgccggcggggcggtcatccaatggcttcgtgacgaaatgcgttttctcaccgaagcgcgcgacgccgaatattacgcgcaaaaggtggaggataccggcggcgtctatctggtgcccgcgtttacagggcttggcgcgccctattgggacatgtatgcgcgcggctgcctgatcggattgacgcgcggtacgcggcgcgaacatatcatccgcgccgcgcaggagtcgatcgcctatcagagcgccgacctggtgcgtgcgatggagcgggataccggcgtcccgctggctgaactgaaggtggacggcggcgcctcgcgcgaccggtttttgatgcagtttcaggcggatatcctcgataaacgcatccgccgccccgttgtccgtgaaacgaccgcgctcggcgcggcgtatctggccgggcttgcggtgggcgtctggagcggccgggaggaaattcgcagactgtggagctgcgacgccgccttcacgccggatatggacccgatccggcgcgacagcctgctgcgcggctggcataaggcggtcgggcgcagtctcgactgggaagaacatacataaaagccgaaaggcccggctgtctttttaagacagccgggccttgtaatgttttatggcggcgggcggcgcttcaatccgactcgtcgcggcggcgctcaacctgccgcagtacctctgcagcgtcgcgcttttccagcgcgccggcaaacgctgtcacatgccgtcattacgccggcctgaaccgcgtctttatgccgggcagccgcgaccggtttgacaactcatcctatgattcgcccgctaagatggaccggcaggtcatttcggatatagccggctaacttctcagccaactgtaagccgcatgccggaaggatgcatacaagacctggacatcccctgcaaaagcgtgcaaagccttgccatacaggcgcagatatgatagaataatcgatggaataaatacatatgtgcgccgatcgcgtacatttaaaggggattttcttatggattatatcagcacgcgcggcggccggccggtttcggcggcacaggcgatcgtgtcgggccttgcgccggacggcgggctttacgtcccgcagtcgctgccttccttttccctcgatgaaattgcgtcgcttgccaagcttggttatacggggcgcgccgtcgaggtgctctcccgctttttaacggactttacgcgcggcgagctgacggaatatgttggccgcgcctatgcaaaaagcaagtttttgcccgaggctgtcgcgcctgtcgtaccgctcggcggcgacggcgcgtatatccttgagctgtttcacgggccgacctgcgcctttaaggatttcgcgctccagcttctgccgcttctgctgacggcttccctgaaaaagacaggcgtggacaaaacggtcgtcattctcgtggcgacctccggcgatacaggcaaagcggcgcttgaaggtttcgccggtgtgccgggtacaaaaatctgcgtattctatcccgacggcggcacaagcagcatccagcgccgccagatgacgacgcaggcaggcgacaacgtgatggtgttcgccgcaaaaggcaattttgacgacgcgcaaaacggcgtcaagcgcatttttaccgacgcggccttcgctaaggctctctctgagcatgggtatttgctctcgtcggccaattcgatcaactggggccgcttggtcccacagattgtctattacttttccgcctactgcgagctgctgaacgccggacgcatcaaggctggcgatgcgatcgacgtcgctgtgcctaccggcaatttcgggaacatccttgccgcgtggttcgccaagcacagcggcctgcccatccggcgtttgatctgcgcgtcgaaccgcaacaatgtgctgaccgacttcatcaaaaccgggacgtatgaccgcaaccgtgatttcttccttacgacctcgccgtccatggatatcctgatctcctcaaatctcgagcgtctgctctatctgctctgcgggcgcgacgacggccgtgtgcgcggctatatgcagtcgctcgcaaaaaccggctcctacacggttgaacaggatgtgcttgcccgcttgcaggcggaattttcagcgggctgcgccgacgatgcacaaacggcgcagacgatccgagacatctgggaaaagacgggttatctgtgcgatacgcatacggccgtggccgtgcatgtctgcgaacaggcacgcggcggcgacaaaacgccgattgtgattgcttcgaccgccagccccttcaagtttgccgccagcgtcctgcccgccgccttcggcgtcgcgccgcagggcgacgatttcgcgcagcttaacaccctttccaaagcgtccggtctgagcgcgcccgacgcgttggccggattgcagggccggaaggaacgttttttgactgtcgtcgcgcccgccgatatgaagcaggccgtcgccggctggctctcgcttttttgaaaaatagcttggcaaaaaactttccggcctttttgaaaaaaggcctcagcgaaaaactttagccggctgcgccgcaaacagtgggtttggtgctgcataaaagtaggctgtgccgcgaacagcggggcaggtcccggcgtttttacaggctgcacctgtcccgtgaggcgcgaaaaggggcacagccgcggcttgtccgcgcccggcgctctggcgccggaaagccccgaacagccggccgggcaagcgcagcgcccggcggtgagcgacccgcgcacggattgtgtgcgccccacggcggtgagtgatccgcgcacgggtcgtgcgcgccagcgcgactggcggggctttcagaatcgccggctttgccgaacaggcgttatgccgccgcaagctatatatcccccagataagccgtactatttttaatgaatcatcaggagaagcatatgaaatatattgtcatgcttggggacggtatggccgaccggccggtccccgcgctcggcggcaaaacgccgctggaagctgcatatactcccaatatggattttttggcgcaaaacggcgtgacgggtatggtacgcaccgtgcccgaagggatgccgccgggttctgacacagcaaacctttccgttatgggctatgatcccaaggtctattacagcggccgttcgccgctggaagcggtgagcatgggcgtggagcttgcgccggacgatgtggcttaccgctgcaatcttgtaacgctttcggatgcgccggagcttgaggacgccgaaatgatcgattattcagcgggagaaatttcgaccgctgaggccgccgatctgatcgcctgcctcgatgcggcgttccatgcggacgactgcacgctgtatgccggcatcagctaccgccattgccttgtgctgcgcgggacgcagacaggaagcgactgtacgccgccgcatgatctttccggccagccggtccgcggacatctgccttccggccgccatggtgcgcgcctgcgtgaaatgatggagcggtcgcgtgcgctgctgcgcgatcatccggtcaatcaggcgcgcatcgctcgcgggctgcggccggcaaatgcctgctggttctggggagaaggtacacggcccgcgctgacgccgtttgagcagctctatggcatgcgcggcggcgtgatttcagccgtcgatctgatcaagggaattgcgatctgcgcagggcttgacagtatcgatgtaccgggcgcgaccggcaatatcgacacaaacttcgccggcaaggggcaggccgcgctggagctgctgcaaaacggtcacgactttgtttatatccatgtggaggcccccgacgaatgcgggcatcgcggcgaagcggaaaataaagtcgcttcgatcgagctgatcgaccgtgaaatccttgggtgcgtcttgcccgccctgcgcggaagcggcgaagccttttccgtacttttgatgccggaccatccgacgccgctgtccatccgcacacacacagccgatccggtgcccttcgcgctttaccgcagcgacaccgtgccggacgcacattggcgcgcgcctgcctataccgaagcgcatgccgcttccaccggactgatgatccccgcggggcatcgcatgatggaatggcttctgcgcggtcaaatgcccgaaaattttgccaaaagctgttgacaagcagccgatcggatggtataataattgagcgtgatcacactgatgacgtgcaattgcgggtatggcggaattggcagacgcgttagattcaggttctaatggtcgcaaggctgtgcaggttcaagtcctgttacccgcaccaaaaaagaatgcccactttggataccatcggcagaaatgccgatggtatcgggcttttcggggggtttttcacctcaaatttcacagctaaaacaaaagatccaaacagggggttcacagaagctggctggatccgaaccccaaaattctatagaaatccacagcgtcctttttgaaatgagatttttcaaaaagggcgctgttttcatatcccgaaaaagggcgctaaagttacaagggaggcaaagagatggaaaacaccaatgtccggcaggaggaaatccgcagccgcttcttcggtgaactgtccctgcagctgcgggaaaagggcatcgtatcagagaggaagggcacaaacatcctgtgtgtgtatctggacggggaacccgtctgcgacgtccaccctaccagcaacgtcttcagctgtgaaggccgcaaaaaatccgaggaggctaacgagctccaatatgaaacagccaggatcgcgcacacggtcagggcgtacctcaatgagttggaagccgcgccccctcccccctccaaggatcttgactccgaggatggttacaagcatctggccggctttggcgagggctttgagcagcgggcaaatcaggcgccggacggcgagatctatgcccatccgtggagtccggacggcgactggagcatccagaccgagcaggagctgttcggttccaggctggaccgttatgaggaacagaagggaggaattacccttgggtaaaaaaatcttcgaggtagagatcagcaatgatgggccaaggggatatgaaacggccaccgagttggagctgcccgcgacctgggcggagtttcacgacgcgctggagaaggcccggattacggatgggtcctgctgcgggattgaagcgactgagatccaccacaaggagatttccgaagcggatcttgggaaagtcaaaaacctgtatgaactcaacctcttcgcccagcgcctctccatgctggaagaagatcaggcatgcggctttgagggactgctgcagatggaacgggacagccggaccagccctatccccctgcaaaggctgatcgacctgaccttccataccgactcctgcctcatagcgcccaatgtccacaacatcagtgacttgggcgcctatttaattcataatgggatgctgtcggatgcggcggccagcctgctggctgaatctgatgagggtagcgagtttcaaaacgagctgctggcacttctgggaaaacggcatatggaggaaaacgcaggcgtattcacatcatatggttatgtggaaccagacggcggtgaatgggaggaggcatatgcccccggcaagatggcgtattttacccgaagcggcgctcctgtggcgctggaggttggaaaagcggaagatcatggcagcgggctgtctgctgttttgaatctcccggcttgtgaagctgctgtaaatcaggcgttcaataccatagatatcttttgcaaagaatacttcgttcaatgtgtggactgcctgatccctgccgcgagggaatggatcaacgacgcggtccaggaggcggacggtattaaggcggcaaatgaattcgcgcgtcagctcgcacagaaagaacgggtatgggacgcggcggagtttaccggcgtcttaaaggaagaacctctgcccgactgggcaagagagaagctggagcggctgcaatctcatgagacgcagccgccccagctttccatgtgaaaggaggatttttacaaatgagaaagatcaggacgcctttgctggccagcctgctggttttgtccatgagcgtcaccgcgtttgcagagccgccgcagacggttatcggcgcggacgggaatgggaccagcatcaccatcaccgacatcacccccagagaggacgaggagaatgagcagaaagcagagcggaaaacaaactacaaggtggggagcttctatcccatcgagatccagaccgcagaggaggatagaatccgcctgctggtcaagaccttccttgtgccgcagggtacagaccccgcggctctcgtcgaggaggggatgaccagaggggtggcccacttcgcctacaaaacagccctcagggagcggcagtacgcagtcagcaaaatccgggagatcccgcaggacaactgggactacctcatgcgcactgaggataaacgcctcacactcattacctgcatcaccggcaagcccgattcccgccttatggtgcaggcggtcgaagcttagtccctctttcttgttggatttggtgatagcttgcccttgcttttgctggtatcctttgtggcaaaaggaggctatccactatgaaaaaaccctgagagcaatgctcatctccgtcatgctgctggcctgcgccgtcaccgcccatgccgcgctctctgaaccggaggggtatccggtcaccgtcaacgactggaccacccccgccgtcttcgcggccggcaaagattggcccatcaccacctggtacctctatgctgaggatgatacggtgctggggagcatccccaaccggacggtgatggagcttgcaaaacagcatcccaccggcagcgtgcagtgggaaacctggctggcggaagcctttaacgagtaccggcagatcagcagctttacgcagaacagcaaagcagaggaaaaacagctggtcatcgaggccggcccgccgatagaatccaacgaggattttgacgccgaagccttcggcctcatcaataaggcgagggcggaaaatggcctgcatgaagtgaatcaggacgaggaggcgatggagctggcaaagatgcgggtccccgagctggaggagcagtacggccacatccgcccggacggcacccggatgtcgcagacctaccggtgcgcagagatcatcaaccgcagggcgtccaccccacagctcgcggcggagtcctggctggactcgccggcgcatcgatcatcctggatgtgcggtaccacagcgcgggcgtcgcctgctggaagggtgcagattacgtcgcctactggtggtgcatgctcttctacaaataaggccagccatgtcgtcgccggtccccgaaagggggcctttttttgttatgaaaacattcagccagaagggcacaacaacccagcccgcccagagggcaggctaatggacagtataagttgttgcttcaggcggagccgggcagggcatcaggttcccagcccagtgctttcaggcgtttcaggtaaccatgtatttttctgtccctattaaaagaatcgtaatagtcagaggccaaatcacgaaatggcacgttgcttctaagcatgtggtatatggcgattaacatggaatgagcaacagcaagtgtagcacggttcttgccccgccttgcggcgatccgctggtattgcaccgagaaataagccccttttacagaacgtgcggattttgcacattgggttaaaatcgtcttgagcagcatgtttccgtttatcgtttttccgtgctttctccgtcccgcgctctggcagttgccaggacaaaccccagcccaggagcagagatgggcagcactgggaaatctgctcatatccaggccgatttccgccagaaacacctcggcgctgcggcgggcgatgccgggaatatcgcaaagagcgataatcaccgcttcatattcatccatgtaatcctgaaccagtttgtccaagtcggcaatacgtctattcagatcgtcgatatgatctatgacctgcgccagccgctttctttgcagcggtgtggtgattccctcgatggccgtcacaagttgtcccagtttggagcgcatccgcccgtggatcatcttggatatttcctcctcactggttgggacatcatcttcaatgatttttttcaacagctttctgacactttttccgttgatgtctttgaccacagaatccaatttgatgttggcgccctccagaatcttttgtagacggttgctttctcggcaccattcctctgtcagactttttcggtaacgggtaatttcacgtatctcccgctgtccccggctggggatataacttgctttcagcagtccgtggcggagcagatccgcgatccattctgcgtctttcatatcggtcttaaggccgggcagtgctttcatgtgcgccgcattgacaactatggcatccaaatccatggtggggctgtccagggcggcccgttctgaaatcagccctgccgccgttttgccggtgaaggcaaagcggagcttgttctgcacaaaggcatagaatgcctttgtggtttctctgtttttgtcgtagtcgtagctgcactgttcaaacacatccgcgatcttttgataggcccagcgcccgctggcccgaatttcgcggatgcgctccggtagctcgttgaagtagtcccggccgaagggcttgctgttttttagcatgtcatcattgaggacaaatcccttattgatgtactctttcgcgtttttgtagcccactggcggaatcaggtggcttttttagagttcacccggtatcccacgacaatgatggcgtccagcttgtagtgctccaaggtgcggcgaacctgtcgggcgccttcttgacgaactaccgagaatttctcggtagttgcctgcggcgtcagctcatcttccgcataaatatttttaggtgtagagagagcttgtctgttgtgcagtcaaatagctctgccgttccactttgtgtgagccataaagtttcttcctaaaatacaacgctgacaaactctttctcgccgttgttttgatagagcaggatttcgccctgttgcataggaacagattccataaataccccctccctatcataattacagataacattgtaactttattttcaataaaagcaagtgtaaataaatgcagggaggacagcggatggctgccctccctgcggtttacgtggacatgggcgaagggaagtctttccgggcttggacttcctgctctgccagacggcggcggttatagagcagcagatatcgggtctgctggaatgatccgattctcaagataaaaaaccgcgatcagatagttctgcgttttgtactgctgatagacgggtttcagtgattcttaaaaagccgcgtcatttttccgttcgggtcagccacagcccgacaattttacgctccttttgtacgtgcatgtacaatgggccattatttccttgccaatagttccctccatcttgttaaaagttatatacctaggaccaatcctggtatttcatttactggctaactatctgaatatgattgtcagtgaacctttgggagaaccattgccggaatccttcgactccactccgcaggagtgggagttcgtccgcctgcttgcccaactgtttccagagcagcaggaacttgtgattgcctcgcttcatgggattctcgatgccaacggccgcagtaggcacccatgtttttttaatgtggattattcaaaaaacaccgccggcgacaagcgcaccatgcgcatttccgtcggtggtgttttactatgtatgtgcaagatttctccgggtcactccgattggcccagcaattctgttgccgttttatcatacccgctgttggaactcatcaaatgatcaaaaccttccagtttttattccagttccagacacagggtgtatcgtttctcttaagaaggaaccataagcaacctcatcataacgcaggaagctcataccaacagaagcttctttcccatatgggacagcttctgcgcaatagattcttccaactcgttaccgacaataattgtatcaatggcatccaggccagcaatagaaaacatggcgcgggactggaacttggaatggtcgcaaaggagaatgcgctctgatgcattggcgatgccgatttttttaatattgagatcatccatggtatagctcttcagacccatctccggatcgatggcgtccacagagaaaaagagcttgctgactgtaatattgccaagcatggtttctgcaaaaaatccataggaggagcagaagcccttccgtatcatgccgccgatcagcagaagggatagatcgggaatatcctggagttcagctgcgatgcggatatcattggtgacaaccgtcaaatgggattttgatttgagaagtttggccagctccagaacggttgttccggaatccaacataagcttgtcaccgtcatgaatatactccagtgcagctaaagcaatccgttgcttttcttcagagttgaccaggcttttggccacaaaggatggctctgctgaggtagcctccacattacacgattttgctccgccacgaattttaatcagcaaattctgcgctgacagatcgttgatatctctcctggctgtagcctttgaaatacggacttcctccataagatcttccaatgcaacgatcccttttttatttacaaaatcaacaatttgctggtagcgttcagcacgcagcatgatgataaatcacctcggcttcatagtcagcggtagaatactttcaaagcttccacagctcgctgatatagacgatacttattttggtaaataagatggcgaacggcgtttggaatataccgtttttggatgtggttcatggatttggcggcagttggcagatccgagtatgcgccgacagcggcggcggcgcacatggcgctgcccagagcgcctgtttctgtggattccaaaatctccagaggaatacccagaagatcgcacaacatctgagaccagatggccgaacgtgcggggccgccggacaggcgggcagtcggaggaagcgagtgagggcaaagtctgtgtacatgatccatcatggagaatacgatgccctcgtataccgctgcaagcatgtgacgcagcgtatggtgactggaaagattgaaaaaacatgcttttgcaccagaaacggtattggaactgtacagataaggtaaaaaaatcaaatcactggatgcaggatccacgtctgctaccatctgattgcaataatcataggcagagctgccgcagaggtctttgccggaaagaagctgatccaaaaaccagtcgagattgctggcagaggtcgggctggcttcttcccaaaatgtcatatccgggcggaaagagcaaagcgcggtactggtgccgggaatggactgctcagacgggataaggcggcagcagattgaccaagttcccatgacaagacacagccggctttcatccagaacaccagctgccagacaacacgaggcggcgtcgtataatccagtggctacaggcgttccggccaacagtcccgtgcagactgcggcttcttgggagacggtgccgcacagttcagctgaaccttccacagggtaggaaaaaaagctatgcgcctccggtatgtccagagccgcaaagcaatcaggatgaaactggcggcgctgcaaatcaaagagattggtattggaggcatcggtggcctcagtagacaatctcccggtcatgcaaaaccgaatatagtccttgatggagagtacatgggtaaaattggagtatgtgtgcggatcgtgccgcttccaccaggggagcaatacagcagcctgaccggcccaaagctgctggtgggtatattgaaagatctgctgtgccgtcccgttttgatcataaagctgcaacagatcattggcacgggtatcggtagatacgatgctgggaataaccggcgcgtactgatgatccaacacggtaagcccgccgccataaccgcaaaagctgacacaggcaatccgggctggagctatggcggcggattccaatacggaacgaatcacccgacagtttccttcccaaatatgttctgcgggccgttctgtttcaccgtgactgccgcgctgcattgggatacgggtggaggccgaggctataatatggccgctgcggtcgcaaagaatgcacttggtagcggaacctccgttatcgattcccataaaataatctgtattcaaagcaattctccttactgttggtgaattgcagcagcagatacttaggatcattttacttagattatatcagctgtgatgcaatttggcaataaaagaaactgaactgttcaaaacaatacgataagcgggctgaggataatgcacaatacgttcgcctcagcccgcaacttgcatccgcctcacaaaaaaagatcgtctgctgtgcagaatattacaatgttttgcggaactcctttacaatatccataaactcacggacgcgggattcgtctaccgcattttcaaatacaccatcgtatttgaaggtggtagcgcatacagcgccgtcggaatgagtcagctgacgaacgatattgtctttgttgcagccggtgttacagagaatgggagtatgcttgacagatgccttgacgcgggaaagaacctgcgtatcggtttcgctgccggcagtcagaccggaaacacaaatggcgtcagggcggttgttgaattccgtagagcgggcgatctcctcaatgggacgatcagccagatattgggcggcttcgggaacgatgttgaacagcagtttgatctgctcgccgccaatggccatttgatggcgaacggtctgaccgacattggtgttccacaggccaaagtcggaggcgtagacaccgctgataatttcacggatgaatttgccgcccacagcaacgcacaggtccagagaagcgatggggtcccacaggcagttgacgccgtagggaacacggatttcctcgtgcagcgagccgattacccagcccatggcggcaatggtgatgggctctacttttgtcaggtagggaaggctgaattcattggagaacataatgccgtccacaccgccgttttgcagagcatgaagatcacggcgtgcgcactccaatacgtaatccattcctttttctttattataatgaggatctcccggcaagggctgaaggtggcacatggcgataatgggctttttgactccgaacaactcttccatccagttcattaaaatccgcatcctttcaatattatgattataattgatgggttttgtatgtatatacccatttgcacaactgtattgtaacataataaatcaaattatgcaataaataaatcataaaacatcaaataattgagctggtcaaattgcacaaagattatccactcaaattgtaccctatatttttaaaaaataattgcaaataaaatcaaataatggtattattgtaacataaatcagatgaaacagagagcgatgttgatttataatgattttaattgaaccgtcattggcgtctgcagatcaattaaacttacagactcacattgacaccctgaagaatgcacctagtctccatcttgacattgaggatggcaactttgtgcccaacattacatttggtttaaaaacggttcgggcagtggcaaggtatgccaagcagaggctggatgctcatctgatggtaagccaaccggaaaactatgtattggatctgttgcaaatgggtgtacattcgattgcgatacatattgaagcggggcagtatcctgcggtgcagctccaagcaattcgaaagggcggtgggcgagctggcctggcctttaactgtatggcgcccattgaagcaggcctggcgtatcgggaatggatagactatctcctgattatgacatcggaaccggatggaatgggacaacggttcaatgagcatatcctgcaaaagatatcccgagcaaggacgctctatggtccggaaatggagattatggcggatggcggaatcggtgaggaacagatggcggcggtagccgcatgcggtgcaaatgtgattgtgatgggcaggactatttggaatgcaccggacccacaagaacaatacggcgtgttgatggaaaggttacagagatatggtgaacaataagccggtttttggcgtatatgaaaaggcgctgaggctgagaagccttgagaagctatttgatacagcggcatcctgcggctacgagacctttgagctgagcttggacagcaccgatcaacggatggccagactggattggaatgctgcagaacgtcaggctgtacgcaatgcggcatccaatagcggcatcaagcttctcacgacctgcttgagtggcggaaaacggtaccctctggggagttcaaatttggagctggtgcacaaagggctggaaatgacggaaaaagccattgccttgtgcggagacctggggattcgggtgattcagctttcaggatttgatgtatacgatcaggagccgcggacggctgagacacagaaacgatatgtagagaatctgtttcaatgtgtgcagatggcggaaaaagcatgtgtgaccttggcgattgagccggtggagggcaatttgctggccgtccgcgatacaatgcaggtaattcgcgccatcaattcctgctggctgcagctgtatccggatgtcgccaatatcaattcgctgggaatcgacccaattcgggaactgccctatggcgcaggacacattgtggcagtccatatgcgtgattcgatcattgactgttacgatgccaccattccatttggaaccggctgtcttgattttgagggcgtttttcgacagttggcggatatgaagttctgcggccctttggtggtggagatgtggaatacggaggcgccggatgatcgggagcgaatcattcaggccagaacctatatggaacagtgcattgagaaagtgagggaacagcatgtgggaagcggaaaaggctaaagtgctccaggcggcattggaaatcaaaaaaaatggtctagtctccctgtccggcggcaatgtcagcatgcgtgtaggggaggaccggtatttggtcacaccatcaggtatgctctatgagaatatgacgccggaggatgtttgtgtcattgacggccaggggcgtttggtagagggcacacgcaaaccgtcctcagacgccagtgcgttgctgtacatgtttgatcacatgccaaagatccatgcgattattcatactcaccagccatgggctacggcagccggctttgatacggacgaactgccggagtttttggtcacagtcatagatgcctgccatgcgccggtcaaggtggccccgtttacgccgtcctctgccattggcatgggggttctagctacggaatatgctggagatgctctggcagttattttaaagcaccacggtgtgctggcatacggcgccaatctggatgaggcgctgttttccgcaatctatctggaggaggcggctaaaacctatgtgctggcccgggctatgggatgcggtatcccacagctggatccggcgctgatcgctcaggaaaaagccggatggcagacctacggacagtgaggcgcaaatgaaaaacagggtatcatcctacggcggatataccgctattggactggatttcggaacgcgggaagcgcgggcgcagctccgcggtctggatggaaaactgcttggagaagctgtgttttcctatccccacggtgttatgagcgaccggcttccggatggaacaacgctgcggcctgtggatgcgctacagcatccacaggactacatagacgcgctgcacaccctgattcccgcgctgctccaatctggagatcccaaccgcgtggtgggcgtgggggtcgattttacacaatgcaccatgatgcctgtgggggaagatggcgcgcctctgtgtcaaacggaacagttcgccaatcaacccatggcctacgctaaactgtggagacaccatagcgcacagccgcaggctgaccgtatgacgcaggttgcacagcagcgcggagagatgtttctggcctattgcggagagagcgtctatgcagagagtatgtttcccaaaatattggagacattcgagcgggcgccgaagctctaccaggcggcagatgcatttgtagagctggcggactggataccctggtatttgacaggagaacgccgccgcagccgcagcatagcaggatgtgctgctctatgggacccgacggctgaatacccttcctttgactatttagaggcggtagcgccggggttcgggtctgcgctggacaaattgcgcggaccgctggtagcagtgggacgctccatcggcggcctgcttccggagcgggcggcacagttggggctgccggcaggaattccggtggccgcaggattgggggattgtcaggcggcttttttgggcgtcggattgtatcagccgggggtactgctcagtgtgatgggaacctccagttgtgatatggtcatccattcagaacgaattgccattcccggtatgtatggaatcagcagtgacagtatgatcccaggttactacggctatgaggcgggacaggctaccatgggagatctgttccgatggttttcagagcagtgggtgccgaaggagattgaagatgctgcaaaagtgcgtggagaaacggtttttgattttctcaaccaccggattgcagcgcggcagccggctgccagcggcttgctggctttggactggtggtgcggaaaccgcaccgttcttttggatacggatttgagcggtctgttggttggtatgacgatgaacaccacatgtgaagatgtatatcaagcgctgatgcagtctttggcctttggaaaacgtcgaattgtagaacaatttcaaaactatggtattcctgtggcacgtatgcgggttacaggaggtgtggcggaaaagaatcccgttctgatgcaggtgtttgccgatgtgttgaaaatgccggtggaggtttccgacgaggccaacggcagctgtaacggcagctgcatttacggtgcattggcaggaagcggctttccgaatatggaactggcagcagcagccatgggcggcggcgtatcccgtgtttattatccgactccggaccgaggcaggatgtacgaccggctatatgaactatactgtcaactccatgatgcgttcggaacagagacatcgatcatgaagcagttgaaggcaatgcaggcagaggagggaaaaaagtgaaatttggatgtttttcgctggattttagaagatttccgttggaacacgcctttgctgcggcacagaagtatggatttgacggcttggaaatctggggaggaaggccgcacgcctatccacaggatgtcacatcggagctggcagcgcaggtgcgacgctggaaaagcgtatatggcgttgagacccccatgtatacgccggtcagcattggaatgccttataatctctgtgcagaaaatcagcaggaaagacaggacaccttggcatattttcgcaaagcgatagacggctgcgcagccatggagattccgaggatgctggttgtggcggatcatccaggatatacggtccggcggcgagctgcctggaggcaatttgtagaaaatctgcatatacttggaagctatggagcgcagcgcggtgtccgcctggtgatagagccgctgacgcccatggagagtccagtcattacgaccgcagatgactgtgcggacgctctggaagagatcgggcttgacacggtggaagccatgctggacgtggtgccgccccggattgcccacgaacctttatcgtcctactttaccaagctgcgcggacgtatgcagtatatccacctgtgcaataacgacggcagaacggacgcacatacccggctggatgtgggagaactgccggtggaggatattttgagtctgattacacaatatcggtttgacggctatgtgacggtagagctctattccgaaaactacagagatcccgaactgatgctggccaatgccgccaggctgctgcggcagtacagtaaccgattagatccggaaggtcaagggtgagtatatgagcgagtatgttctggagctaagaaatattgtgaaacgatttccgggtgtggtggcgctgaataatgtacagttccagctgaagcccggagaagtacatgcgctcatgggtgaaaacggcgcgggtaaaagtactctgatcaaggtgattaccggtgtacataagccagatgaaggagaaatcctggtaaaagggcagccggtggtctttcagaacacaaatgactctgcagcgaaaagcattgcggccatttatcagcacagcacagtgtaccctcatctgagcgttacggagaacatctttgtgggacatgagcggcggaacaagctgggcctggtggattggaagcgaatgcacattcgtgcaggagaattgctgcggagcctggggtcaggcattgacccgcaccggcggatgggtgaactcagcgtggcggagcagcaaattgtggagatatccaaggcggttgccgccaacgcggaaatagtcattatggacgagccaacagcagccctgtccaagcgggaatgtgaagagctgtatcggattacagagcagctgcgcaatgagggaaaatccataatctttatttcgcaccggttggaggatatgtatcgtctggcagaccgggtaacggtattccgggatgcaatgtacattggtacctgggagctgcgggagttgaccaatgagctgctggtgcaggctatggttggacggacgatcacagatctctatcccaagaaaaaggtgcctataggggaaacaatcctggaagtgaagaatctgtgccaaacgggcaactttagaaatgtttccttttccgtccgccgcggcgagatttttggcctgaccggcctggtgggggctggacggtcggaactctgccaggccatctgcggcgtgacaacctacgagagcggaacggtaatcctgaatggagaaaccgtccggtttacccatccgctgcaatcaatgcagaagaagctgggttaccttcctgaagaccgtcaggttcaggggttggtgctggattggtctattttccgcaatattaccttgccgtcactgagaaaatacagtacagcggcaggattgaatagcaaacaggagcgccaggacggagaagcgttccggaaaaagctctccatccggaccaaggacattgatgagaaggtcagcgccttgtccggcggcaaccagcagaaggtcgtatttgccaagctgttgaatctggatctgaacgtactgattcttgatgagccgaccaaaggtgtggatgtgggtgcaaaatctcagatatacagcattatgtcggatctggcagagcagggatatgcgattatcctgatctcctcggaaatgccggaggttctggcgatgagcgaccgcattggtgtgatgcacgagggcagcctggtaaaaatcctggaccgaaaagaggcgacgcaggaaaagatgctggcgtatgctatgaactcggcagacaccatgctgaaggattaaggaggtgcggcaagtatggaaacaaaactggtgtccggacgcatccggcgctttttgcatgagcgcacacagcaggcggccttgctgggcgtcattctgatcgtaagtattctcgtacagctgcgcacgggaggcagtttcctgacggcatccaatcttaatgagatgatgcgcgaggcatccatgctgataattgtttccgtgggaatgatgattgtcattgtgggcggcggtattgacttgtcggtgggttccgtaatgggtctgtccggaatgatcgcagccctgacgctgcgggccaatccgcaaatgccggtgattgcggtctttctggtagccatgggcgtggggctgatctgcggcgtcattaccggctttgttgtggcggagctgcgcatatttccactgatcggtacgttgggtacatgtgatattctgcgcggtgtgatttattggttcagcaatggcgaatgggtcgggcagtccgacatgacgccgggctttctgtccattgctacagacaaattgcttggcatcaactgcatggtatggtttgctgccggcgcagtgatattcggaacgattctcatggggcatacccggctggggcggcacatttatgcggtgggaaacagcgaacactgtgcgaaaatttctggtatcaatacggtaaaggtaaagtggatttcgtatatattcagcggtgttcttgctggtttagcgggtgtgctgtgggtttgcaaatatgccaatgcacagggtactacggcaacaggctatgagcttaacgtcattgcttctgtggttttgggaggtgtcagcatcaagggcggcgcaggtacgatttttggtgtggtacttggttcgctgctgttcggcatccttaataatattctgccattgattcaggtttcttctttctggcagagagccattcgcggtgcggtgattctgctggcggtgattatcaactcgttggtagcccgcagagcagctaaaagagcaatggaaaggagagaaattgatgagacagcgtgagcgaaagcaggaaaacacgttgcgtcaaaagaccgggtggctgtttgctcagtgggagacgctgctggtactgatctttcttctggtgaatatcatcaatattaacctctctccctattatttgaactatactaatttgatgaattccatgatcaacttcatggataaaggattgatggtattcggcatcatgatggtgctgatattgggtgagattgatatttccattgcatccatcattacgttatccgcctgcacagcaggatgggccggcgaactgggggtgccgctggcgggatgcgttttggttgctttgctggtcggcgcactgtgcggcgcgttcaacggcgttctgctggcggcgtttccggaattgaactccaccatcgtgacactgggcacacaaatcctatatcgtggtctggcgtatatgctgctggaggatgaatcgctgaagacctatgcgaaacaattgtcggatttggcttgggaacgaatattcggtctgcctgtgattctggtggcgtttattatcctgtctgtgatttttatgtttgtcatccatcgaatggcatttggccgccgtctttacgcgttgggatccaattacactgccagctatttttcaggcattcgcacatcgcgcattaaaattatggtatttaccatcagtggcctgtgcgcgtcttttgcgggcctgttcctggcagccaagcttgcctcggttcgcgccagcattgcccagggatatgagatggaagttattgctatggcgattctgggaggcgccagcccatccggcggaaagggccgtgtaggtggtgtgatcgttggcgtgtttaccatcggtctgatccgatatggtacagggttggtcaatgtatctgcggaaacgctgaaggttattatcggtattcttttgatcgtggtttgtgcagctcccaatatgaaacaagtgttggcggatgcaaaggaatccagacgaggcaaacgtcagcttgtaataaaaaaaggaggaacctgataatgaaaaagatcttagcacttacccttgctctgtgcatgctgtttacttccatggtaggatgcagcagcggatcggataccactgcggccggcaccggcagcaatacatcaacagaggctggaacgacccagccggataccggtgatgcggaagccagcgaagaaccgacagagaccaacgatgatccgacagcggatttacaggtcagtgaagatgctcccacctatgtgatggtgtccaaaacgctttcggacccagtgttcattgatatgtatattggcttccgggagttctgtgagagcattggtgcaaactgtatgtaccgtggttcagatgaacctacggccgaaaaagaaattgagattattacacagctgatggcgcaaggtgtggatggccttgcagtaatcgctgcggactttgatgcgctggaaccggtgctgactcaagccatggggcagggaattgctgtagtgacatttgactctgccgctaacccggattcccggcagctgcatgttgagcaggcttccatagacctggtaggccgtgatcagatgaagtcggctttggagattattggaggacccggcgcagaagggaccgtcggtattttgtcggcgcagcctgagtcccagcttcatgctgattggtgcaacgccatgctgaaagaagtggaagacaatcctgaggactttgccaatgttacggtgctgcccattgcctacggcgatgatctgccggacaagtctaccactgaagcgcaggccatgctccagaattatcctgacattgatgtcatcattagtcccaccactgttggcattctgtctgccgcgaaggtcattcaggatttgggttcggaatgtaaggttaccggtgtagggctgccttctgagatggctccctatattgaaagcggcatttgttatgattgctatctttggaatccctacgatcaggggtatttggctgctgcttctgtcaactccatcagtacaggggaaagcacaggcgctgtgggcgatacggtgacggcaggccgccttggagagtatactgtagaggagtactacgatggcggcacacaagtattactgggagaccccattcggtttaccaaggaaaacattggcgagtataaagatttgttctgattttcaaatcagtaattgcccataaaagagtatttgctcctccatcgctgggcctgcgtacaggcttaacgatgggggaacatctgttctgcaaacgggtacttcgcttgcaaaataaaggagccttgatggtgttttggcatgcaatgattggtctatgtaattccagacattcttattcacagcaggagatgtcaggaaacaacaacggtgtgaaatcacgaaaggcccgctgggttaccccagccgcggcgctctgccagatccggcagtccaaaggaaaaccgctctgactgtatccatgtagtctgtgatgggtcccctccagagatcgtcccaggcggccggccaaaaacatcggcgtaccagcgataccagcagggacggagaaaaggtcacaggaatgaggtgatcattactgaggacccaacgatttggaatcgaaattgagatgaccggcatcacaagggcggcagccgcccgggtggtcgccggttattttcataccacagcgcttcatgcaggcgggatctacgatacctatacggtgcgggatgagcagaaccggcagtggaaactggtcaaagattcctctattcaatgtgaaaatcgcagcggcgacccggttggcggggcctatgcggtagaaatggtatctcccatctgtgtctatgaggacatcgtcgtcatccaggagctcatccgcaagctgcaggaggcgggcgcgaaggtcaacaattcctgcggcatccatgtttatgtggacgcctccgcccacactgtaaccaccctgcgcaacatcgtcaatatcatggccgcaaaggagatctgctctacaaggcgcttcaggtgaacgtatcccgagagaaccactgccaaaagcggatacccggttccttgacgatatgaaccggcagcgcccccgctccatgcaggagctggaacagctctggtataacagacccaacgggcagagtgatcattacgattgcaccagataccacgccctcaacctgcacagtgtggtggctgatggcgaggcggagctggatatatgccttgatttttttcgcgtggagggtggagttgaacagccggaattcaatggtgcccttggagaacacacgttggagcagaaacgcgcgaagccaacccgaacccataacagcaatgagaaatacaccttccgcacctggctgctccggctggagatgatcggtgacgaattcaaaaccgcgcggcagcacctgctgaagcatctggaggggaatatcgcctggcgggacccggaataggcacaggcgcagaagaaacggctggcagcgcagcagctggcagagagggagcgcgtgctggaatgggaacaggaggaaacagacccctctgaaccagaggaagaagcggctataacaatgaccatgcgaaaggatggatgagaaatggaaaaacggctctatgtcgcatacggaagaaacctgaatattctgcagatgaagcagagatgccccactgcaaagctatgcggtaccgggacggtagaaaattatcagttgcagttcaaaggccgcccgcaaagcgccttcgccaccatctccccaaaggagggctcctctgtcccggtggcggtttgggagctgcagccccgggacgaacgggcgctggaccggtacgagggatacccttctcactacttcaagcaggatatccctgtgcaactggacggtaaagaggttgtcgggatggtctacatcatggatctggaaatggatcacggcctcccttccctcgcctactaccagacggtacaggagggatatgaggactgctggcgtcggtgatgatgctgatcgcggagttttgcccgtccgaggaacggcacatcgtgtcggtattcaagctcttgcaggatctccttgctcccagcaaggtcaagggcaaaaaccacttccagcttttgatggagcagctcccaccggaacacaaggcgcgatggatggcgggggcggcgctccacaccggggagcaggccatgctgtcagtcctctccaccgccatgagccgtctcaacgcctttctggacaccgagctggaacagctcctctgctttgacagtgccattgatgcggagcggttctgtaaggagaaaaccgccctgttcatcgtcatgcccgaggaggatcccaccgcctattttctcgtgagcctcatcatccagcagctctactgggagctgatgacggtggcggatgaaaatggcggcaagctgccccggcgctgtatcttctatgccgatgagtttgggaccatcccaaagctggagggggccgagatgatgttttccgccgcccgctcgcgggggcttaccatcgtggcgattgtgcagggcctcatccagttggacaaaaactatgggaaagagggcgcacaggtgattcgggacaactgccagctcacgatcttcggcggctttgcccccggcagcgagacagcggagacgctctccaaagaccttggggaacagacggtgctctccggctcggtgagcaagggcaaggacaataactcccgcagcctgcagatgatggggcggcggctgatgaccccggacgagctgaaaagcatgcccaagggccagtttatcaccatgaaaaccgggatgcacccgatgaaaaccaaatttggcctgttcttaaagtggggtatccgctttgggaagcagtttgaactgccgtaacattccgcccgcaagatacagtatgccggacgggagaagctggcggcggctatagcgcggcaatatccgaaagcagatgacaagtgtgagaggcttcccttagaagaaattcctgtgcgggaagccactgcaaaatcttcccgcaggcatccgcctcgtaccgaatgagaggagggattcattgcgtagactggaacaaatctatggggacaacgcgctgccccaccgggtaaaagccgtttacatctatctgtacgaccgggcggatcgggagggaaaaagctggccctctctttcgaccatttccaaagatcttgcactctccagatccaccgtcaagcgggccatcgccgacctcaaggcggtgggatatctggaaaccgagcagcgatggcggcgaaacggcggcaggaccagcttgctttttaagctgctgaaatgattgatggctgaaaaaatcacagtccacaccaagggtgaactgcgcccttgggtggactgtggtacggttcgtcatgggctgaggaaggggaacttcccactggaaggataacgatgaacagagagaataatgggttctcccataatggttcgcgctaatcttcatttagacgtattcatttccgttcctctcctgctcctcctcccccaataagcaatcggatatggttgtgtgaccagattgttttgtacagcttttctaacggttcatcggaaactgtatagcccgcccgtttgagcaatgtaaccatgatttcatatccagctaaataatagtattcttgggaatcctcaatggcgctttttcttctttcaaactgcttgttaacttcctcgcgcgcctctggcggaagctcttttataaatgattgacaaacctgtatcaattctgttccttatccgcatgaccaggaatttgtttcagatcgactgttttaacaatctgttcgagcagatccccagccgcacttagaaaaccttgtgcaagataataatcgttgatgagttcttcataatcaataaaagcatctgtgacagaagaatagctgtctcgcaggtcgtattttttgggacagagacaggaagaatgataatgctccctatactctcgatagatagaggagtaccgcttctgatagggtatcactatagaggaaagttcgcccaatataccttctataaattcttctgtgattagatgtttttgagacattgcgcggccccctttctattttaacgtgtggcgctcaatctcctgcgctataataccccggatgctgatgtatcttcatctaactattaccgcacacgggaatagacgggtatttttattgctatcataaagaaaatactgtatgagtattaactaaatgatagcaggtagaaaagatgaatgaccaatattcacagattatcgtcaatcgaatactgtcattatgtcagcaacatgatttcacgatatatcagctatctactatgagtggcattagttattcaacactggataaccttataaagtacaagacattcaatcccaaaataaagacactccacaaaattgcttctgcgtttagtctcacattgtctgaattttttgattaccctgaaattgaaaatttttcatttgatgatagcaatgattaggagcgagaaacggattttgattgcccctcaagtaatcaagatgcagttcaacattttctatttatcgtatcatgttaggtctagggtgtcaatgtgattcgactaatattattgattttatcatcgttttagactacgccaatgtattacaatattattggggtggttttatgtcggcagatgaagcctttgactttggattacgattacgccaactccgagaagatcgtggaatgtcacgattaactttgacaaaaaagttgggtgtaagtaaagaaactatttatagtggctaatgaggtaacaccatgtataaaagcccaaatggttatgataatatcattttgcttttcttccgaatagtgcgtctgccctaataatttacttacaatatttttatagataatataaggtttatagttttggtcgtctggtattgataatgataagtcaatttttatgttggattgagaatataaaaattgaaaataagcagggttttctacaaagaaagatacataggctatccccatatctttcaaggaaaatcacttttccaacccacaatttttcgtggacgacggttacagtggtacgagttttgaacgcccctcttgaacggaactcattgaaaaggtcgagaacggcgaagtagcaaccttgattgtcaagtatatgtcgcggcttgggcgtgattatctggaagtgggattttacaccggagtcctgtttgtggagaaaagcgtgcgcttcattgccattaacagcggtatcgacagcgtaaaccaacaggatagcgacttcaccccgtttttgaatatcataaacgagtggtattcaaaagatacaagcaagaagatacgcgctgtgatgaagtccaaaggggaagcaggcgaacacctctgtaccaatccgccctacggttacatgaaagaccccgacaacaaaaagcattggattgtcgaccccgaagccgccgaagtagtaaagcgaatattcgcgctctgcttagagggctacgggccgtcgcagattgcctgtattctgaaagaggataaagtcataacaccgactattcattttcagcggacaggcagggcaacgaggaacacgctgccggacaatccgtatcactggacgggcgacaccatcgccgacattttagagcgtccagagtatcaggggcgtacggtaaacttcaagacctacaagcagtcgtacaagagcaaaaagacctgttacaatcccaaagaaaagcagcttgtgtttgagaatacccatgaagcgataattgacgctgacacatggcaacgggtacaggaattacggaagaataaacgccgcccgacaaggacaggcaagaaaaatatgttttctggcattgtacgctgtgccgattgcggtgagaagatctattactgcacaagcaggaactttggagcaaggcaagaccattttgtttgctctacttcaaggctgaaaggaaaagaggtttgcccgacgcattttatccgcgccgttgttttggaacagggcgtactcgcccacatgagattgacgattgcctgtgttgcgaaccacgaagaacaattccgcaaagctatgggcgcgaagcagaaagccgaagcaaaaaaggaacttgcagcaaagcggcggcaactgacacaagcggaacgacggatagaagaacttgaccggctattcaagcgtatttacgaggataacgtaggcgggaaattatctgacagcagatttcaaatgctctctgacgattacgaataggagcaggaagaactgcaggaaaggctgttgcgattgaatgaagaaattacaaaacaggaagaacaggcagaaaatatcgacaggtttataggcaaagtacagaaatatctcgacttggacgagctgacgcccgctatcttaaatgacatggtaaaggcggtatatgttcacgcgctggataagtcaaagggatatagggaacagcagattgacatttcctatgaccttgtaggaatactccccgcgcctttgctgaatagcttgcaaaacggcgaaacggcatagccgaagctacgctgtttccctaaacattcttatgctgttttatgagtgccgccctaagggacgttcttttttgcttgaccgcgtatttgacaaagctttctggaaatcctatacttattttaatcttactatgcaaggagctgcaaaacaacatgagcgaatgtacgcacgactgttcaagctgtggcgaaaactgcccgagcaggcagagcgatcccgctgattttctggaggcgccgaatgaattaagctgtgtgcgccgtgtaatcggcgtcgtcagcggaaagggcggcgttggcaaatcccttgtaacttcgatgctggccgtattgctcaagcgccgcggctacaatgtcggtatcatggacgccgatgtcaccggaccgtcgattcccaaagcgttcggcatccatgaaaaagccgcctcaaccgggaccgcgctcatccccgcgcgcagcaagacaggcgtcgatattatgtccgtcaacctgctgcttgaagatgacagcgatcctgttgtctggcgcgggccagtcatagcaggcgtggtaaagcaattttggaccgatgtcatatggaacgacgtcgatttcctgtttgtcgacatgccccctggaacaggcgatgtgccgctgactgtgttccagtccataccggtcgatggaattgtggtggtggcttcgccgcaggagcttgtcggcatgatcgtggaaaaggccgttaaaatggcgcagatgatgaatataccgatcattggcctggtggagaacatgagctatgtgcagtgccctgattgcggccgccgcatcgagctgttcggcaaaagccatattgacgaaacggccgcgcgttacaagctgccggtgctcgccaaaatccccatcgatccttcactcgcctccaactgcgacagcggcgtgatcgagctgttcgagggcgattggatggacgccgccgccgacgccgtagagcagtttcacgcatgacgattccggcctttttgaaaaaaggccccggcgggcgcgcgtgacccgtgcgcgggtcacagcggcggcgtccgctcgggcgtcctccgccttcgcgtggctttccgaagcgcggcaatcgccgcgcttcgggcgcagacaagctgcggcagcgccacgcggcgcgcctcatgggacaggggcgggccgcccctatcccatggacctacccccggggcaggaaacagcttgatgattttaccacggaacgtaccggcgtgcaaccaatacgatcgcgccaaacagaggtggggataccacaaggggagggccgccggccctccccttgtgatgtgcgaaaaggggcgcagccgcggcttgtccgcgcccggcgctacagcgccgggaagccccgaatagccggccgggcaagcgcagcgtccggcggtgagcggcctgcgcacaggccgcgcgcccttcctccggtgtgcgtttactttaaccggacatagatcagcttgacgctgctgtcgcgtgtgcggacgcttttgatgtcgaacaggccaagcgattcgagaaaaggcgtcagcttggaatgcccaaaattgcgcacatcaaaatcgggatggcgcttgacaagcagattgccgatggtgccgatgaacagccagccatcctcgtccgagttttccgagacgatcatccgcaacgatttccgaatggttttcaggctggtcatctctttggcggccgatgggtcagcttcagcctttgcgttttccctggccgcttccttttccatatgcgccggcgcgggcttgtccgcatccttcttattggcgggccgggacgcgtcctcgcgctggcagtcctcatccttttgcacggccggttcagcctgcgcgagaatatcgagatatttaaagcggttgcacgcggaaataaacgatttgggtgttttgcgttcgcccatgcccacaacaatcatgccgctttcgcgcagacgtgccgccaggcgtgtgaaatcgctgtcggacgagacaatgcaaaaaccgtccacctggccggaataaagaatatccatcgcgtcgataatcatggcggagtcggtggagtttttgccggtggtgtaattgtattgctggatgggcaggattgaattgtcaagcagtacgcttttccatgaaacgagcgcgggttttgtccaatccccatagatgcgtttataggtcgcaataccatcgtttgagatttcatccagaataattttgatatatttgtccgatacattgtcggcgtcgatcaggactgcaaatttcagatcgcttgccaagaaaatccccctttgccgcatgagcggctttttattaagtataacacaaatttgtggtgaatggagcggttttacagcgcgggggaaaatttttcccggaataccattgggctttgggctgaaaaacccaaagcttttttgcagcccaaggaaaacccggcaaaaaaaggccccggccgcacgcagctgcgcgcggccggggctgtatggtttgctttactgcaattcgatctggcgcgtctgagactgcgccggcgtccgcttaggcaaatcaagctccagtacaccgttgttataggcggctttgatcgcctccgtatttatgttggagacatcaaagctgcgggcaaaagaaccatagcggcgctcgcggcggacataaccgtccttgtcctcgctcgtttcggcattgtgctgtgccgaaatcgtcaacgtttcgccattgagatcaattttgatgtcctgcttatcaaagccgggcagctctgcctggagcacataccggtcgcctttatcaaggatatcggtgcgtatttccgaaaaaccagccgggaaatcgttaaagaatgttttttcaaacgtatcaaaaaagttcgctatatttctggtcttgtgttcaaaaggcatcaggtcaaacataaatcaaaacccctttcaaaaaaactgctgctttttcctgatctatgcggtatactgtccgctttatcggtggatattgatccgatacattgcaaccatcttccttctgtcctctaaaggactttctcttgtttcattgattacagtatactggatgattgttacaaaaccagacatgatttatgaataaatttgaaattttagcaatcttatatgttgagtgctaatcaaattgagaggccggatagcacctctgagagcgcggcggcggaggcggaaagcgcgcggttttcctcggtgttcagcgggaagtccagaattttttggataccgctgcgtccaacaattgccggcaggccgagacagacatcatgcaggccataatggccatcggtcagaacagacacaggaagcacggaacgctcgtcacgcacgattgcctcggcaatacgcagcaccgccatggaaatagcgtaatttgtagcgcccttgttttcaatgatgcggtaggcgctatttttcacctcgtcaaacagtccgcgaatgccggacatatcggcgcattttccacagaccttgcaaaaatcaatcaaatcgatgcccgaaacattggcgctgctccagaccggcagctccgtatcgccgtgctcgccgatgataaacgcatgaatgttgcggggatcgacctccaaatgctcaccgagcagatatttcaggcgggcagtgtcaagcacggtacccgagcctatgacgcgctgcgccggaaagccggacagcgtgagtgtgacgcgcgttaaaatatccactggatttgcgacgatcaacagaatggaatcgcggttatactgcgtaatctgcggcacgatcgactggaaaatacggacgtttttgcgcacaagatcgatgcgtgtctcgccgggcgcctgggctgctccggccgtgatgacaatcatgcccgcgtcggccaaatcgggataaccgccggcatagacgttgaccggccgtacaaagggaacgctgtgcgcgatgtccatcgcctcgccttcggcctttttttgatcgatgtccagcaggaccagctcggaaaacaggccgctttttaagagagtaaacgctgttgttgcaccgactgcgccgcagccgatgacagcacatttttgcagattcaagaaatcgcctccttgtatttttaaacctgtgatcagttttccctgtgaggcagtccatattcagacggatcaaaagagactgcgccaaatccactgttcgcggcgcagcctgtataaacgcggtgctaaacccgctgttcgcggcgcagccggctaaagtttttgccgaagcttttttcaaaaaagccggaagcggcagcctgcaaaatccgcgtccaaccgcgcggcgcctgtcacggattttgcttaggacgggcggagcgccccggcaggtatcttgcggcctgcgggccgcgcttttatgagggctgcggcccaaagatcagggcgctgccctcgaaaaaaggcaagacccgcaaggggccttgccttttttctcacccgccgccttttgaaaaaggcgggcgaaaacttttgatcgacgcggcgtaaaactaattatgcagcagctaccccacatttgcggcgcagccgactaaagtttttcaccgaggccttttttcaaaaaggccggaaagttttttgccgaggctttttttcaaaaaagccggaaagttttttgccaggcttttttcaaaaaagcgaaagcttagaaaacggggattacggtgccattgtatttttcattgatgaaggcggctgtctcgtcgctctgaagcgcggcgatcagcttttggatttcgggacggctctcgtcgccggcgcgaactgccacaacattggcaaattcctgcgcggcctcggaatccttgtcctcagtcgtcagcacctggccggcaagaccggcaccaagcgcatagttgccgttgataacagccaaatcaacgtcaggcagcacgttgggaacctgggcggcctcaatttcctcaaacttgatatttttggtgttttccgtaatatcgagcggcgtagcggccagcccgacaccgtcggccagcttgatcagcccgagcttttcaagcagcagaagcgcgcgggcttcgttggtggcgtcgttggggaccgcaatggtcgcgccgtcggccagggcttcgatagaagccgtcttgcccggatagacgccgagcggctcaaaatgaattgcaccggcggagataagatccgtgccgtttttctcgttgaaatcagccagatacggataatgctggaagtagttggcgtcgatgtcgccttcgtcaagcgccatgttggggatgacgtaatccgtaaattcgacaatctcaagatttacgccctcggcggccaaagccggtttgatgctctcaaggatttcggcatgcggcgccggggacgcgccgaccttgatcgtgacggcgtcggcaggaacggcggaagcatccgccgccgcttcggaggacgcgacggtggcagaggcggcagcgtcaacggaggcggttgcttcggccgtggacggcgccggggcgggcgcggacgaggaagcaggcgcggcggacccgccgcaggcagccagagagaacgcgcaggtcagggccagcgcggacacgaacagttgtttgatcgatttcatatgtttgagactccttttaatcaaaagatttctatcataccggaagcggccgcattccggcgatggatgaatgaatcagcggttgcgcttatcgacgcgcgccgcaaggtggtcgaagatgatttgtatcaggcagacgatgacaatcagcagaatgattgtcaggatcataaccttcggctcatagcggtgaaagccatagcgcatcgcgatatcgccaagcccgcccgcgccggccgcgccggccatcgcggaatagccgatcagtgtgatggtggtgatcgacagaccgcggatcagggagggcagcgactccgggagcatcacgcgcaggatgatctgaccattggtcgcgcccatacacttggccgcctccacaacgccattgtcaatttccgacagcgagctttccaccaggcgcgcaacaaacggcgcggctgcgatggtcagcggcacgcaggcggcggctgtaccgatgatcttgcccatgatcagccttgtaaacggaaagagcgccaccatcaggataataaacggcagagaacgcaggatgttgacgatccagccgaaaacggaattgaatacacggttttccataatgccgccgcggtcggtcacgcgcagcagcacacccatcggcaggccgagtatgtaggcgcagacggttgaaccgagcaccatgacaagcgttgcgccggtgccctccagcagcatgggaccgtatcgctgcaaaagctccatcattctttcatcacctcatatccaagaagctgctttgtcatatcgtgtttggggttcttgaaaatctctgcggtgtcgccccattcgacgaattcagaggcgtcaatcacagcgaccttgttgcagatggcccgcacaacggcaatttcatgtgtgataataacgatcgtaacattcagcttgcggttgatatcatgcagaagctccaggatgttttttgtcgtgagggaatcgagcgcggaagtgggttcgtcgcacagaagcacctccgggcttgttgcgagcgcgcgcgcaatggcgacgcgctgcttctgaccgccggaaagctgcgatggatagctgtcgccgcggtcggccaggccgatcaggtcaagaagctccttgacgcgccggtcgatgtcggctttggcggcgtgtccgagcgtgagcggaaaggcaatattttgatgtaccgtgcgctgcatcagcaggttatagccctgaaaaacaacgcccattttgcggcgcgtttcgattaaacgcgtgcctgaaagcgacgcaagatcggttccgtcgagcgtgatggaaccgctggtcggcgtttccagtgtggacagacagcgcagaagcgtcgatttgccggcgccgctcatgccgatgatgccgaagatatcgcctctgccaatctcaaggttgacgccgcgaagcgccaccacctctcctgacttatcgttaaatatttttgatacgtcgctgatttttatcaaagcaatccctccaacatcccgctcgcatcgcggcaggaacaacaaaaaagccctcgttcccggacaaattgtccagggacgagagcgccgcttcgtggtaccaccctgcttcgccgccgcatttaagcggcagcctcaccggcgtccggctcgataccgaccgcctgtcgctttaacgggcgaacccgccgcggactaaaagctttcgcccgcgggactccaagaccatgttcggctgtgtttcccgcgcctcttttcaccaaccgaggctctctgctgcggttctgacagcttactcttcttttcagcgtctttcacagtttttcgcaaacctttttgtagttgctattatactgcttttttacgtttcgtcaagaggaaaaagctgttttcgttgtaattcccatatgggtatgataaaatgagcttattagcggtcattttgtaaaaaggaagcaagggggtttttaaatgtctgaccggagcgcggcgctcgcccggctcgatgcgctcggcgtcgcctatgagctgacggagcacccggccgtttttaccatcgaggatatggagcagttggggctgaccggcagcgggacggtttgtaaaaatttattcctgcgcgacgccaaaggccgccgtcattttttggttgtgatcccggggaattgccgcgccgatcttaaatcaattgaaacgcagctcggctcgacaagactgagctttgcgtccgcggagcgcctgcaaagatatctggggctgatcggtggagaggtgacgccgctcggtattatcaacgatccggacgccgccgtcgaagttgtattcgaccggtcgcttgaaggaaatccgcgtgtgggcgtccatccgaacgacaacaccgcgacggtctggctggcgttcgatgatcttttgcgcattgtcatggacaatggaaacacagtgcactttatcacactggaaacagccctcacatgacatgggggcttgtttgaaaaatcaaaatacccgtttttccggaaaacagcggcgaacgctgtgttaaaaagcctgggaatccgaaaggattcctgcgttttggccatgcgcccgcctgctgtctgcgaaagatcaggctattctctattttctaacaagccctgggcctgcgggccggaaaggggaatgcatatgattaaaaatattatttttgatatgggaaatgtgctgatgcggtttgatcccatggcgctggcctctcatttcgccagcagccaggaggatcaaaagctgttatgtgagcatgtgttctccggaccagagtggtatgcgcttgacgcagggtccattgatgaggaggatgcgctttccagtatcctgtccatgatgccggatcgcctgcatgccgcggcagaggaggcgtttcgcaattgggatcactatttcggcccgattcaggagacaaatgattacgcgcgttccctcaaagagcggggatataagctgtatctgctttcaaacgcaggcgtgcgcttcgcgcgctaccgcacacaaatccccgtatacgactgtttcgacggcgtgattgtatcagcttatgtccggcaggtaaagcccgaccgcgcaatttatgaaacgctgttttctacatacgagcttgagccagccgaatgcttctttattgacgacaacgaacagaacattgccgccgcacgggactgcggtatgcaggggttggtgttcaccggtcccgacccccttccgtcctttcccccgcttttttgaaacttaccttttttgaaaaaaaggtaagacaaaaaactttagtcggctgcgccgcgaacagcggggcgggtggtgcgcgtatacaggctgcgccgcgaacagcggggcgggtgctgcgcaaaaacaggctgcgccgcgagcagcggcacggctccggcgctgaaacgggtcacgctgcaaacggtgaaaacaaaaactgcgtcccgcataaacgggacgcggtgcggctgaccgtccgcctttacggctggaacaaccccttttccaccaactcgccagattcgttgaattcaagctccataacgcgtgagcgtgtgtaacgaataatgggacgcaggcgcggcagctcgtcgcgcccgtagaaaatataggacaccccttcctttttggcgcggcccgtgcggccgatgcggtggagatagtattcgttttcaagcgggatttcgtaattaaagaccgcgtcaacatcgagaacatcgataccgcgcgctgccacgtcggttgcgacaaggatgctgatctcgccggaacggaaccgggccataatctggttgcgctcggattggcgcatgtcgccgttgaggcaatcggcattgaagccgcgttcacgcagcaaattgctcaggcttgcggttgaatatttggtattgcagaaaatcatgaccttgtgaaaatcgttcgcctcaaggatgtaacacaggtcggcgagcttttggcggccgacgctctcgagcatatactgatggattttcggctggctttccttgaccggctcgaccgtcagctcgacggtgtcgcgctgataaagccaaccgatatccattacctcgcgggaaatggtcgcggaaaacatgaccatctgacgctccttcggcaggcgatccaggattttgcatacgtccttataaaatcccatgtcgagcatctcgtcggcctcgtcaagcacagcgatcgacaccttggaaaggttgatcgtgcggcggtgcatgtggtcaagcattcggcccggcgttgcaacgacgatctgcgcgccgcgctttaaggcgttgatctgcctgtcgatctgctgcccgccgtataccgccgcgacccgcacctgcggacgaaaatgcgcaagctcgcgcaattcgtccacaatctgcgtgcaaagctcgcgcgtcgggcagagcacaaccgcctgcacagccagagcagacgggtcgattttttccataatcggcacgccgaacgcgcacgttttaccggtgcctgtcggcgccttggcaatgatctcgcgcccttcaagcatgacagggatcgccttttcctgtatttcagtcaactccgtaaagcccatgcgctccacggccttcaatgtttcctccgaaagcaataaatcgctgtactgcgccatgttctgattctccctttgtcctgtgcaggcctccggctgcatttttttgcataccaccccgattatagaaatagtataccacacagcctgtctccgcgtaaagggctatcagtgtggtgaagcatcaaattacaaaatttttccgaatattcgctatagggcttcattctgtggtataataaccgcagagcggttattataccgggttatgcccagcggctcgccgcttgcgcggcaaccgccttttgatgggcaattataccatgccgcttcgcggacatggtataataaccgcagagcggttattataccgggttatgcccagcggctcgccgcttgcgcggcaaccgccttttgatgggcaattataccatgccgcttcgcggacatggtataataaccgcagagcggttattattccggtttatgcccggcggctcgccgcttgcgcggcaaccgccttttgatgggcaattataccatgccgcttcgcggcagacaagcccgaagggactggccgccgcggcgccataacggcggagcaaacagctctgctgtgcatatatcccgattttatcaattgaaaggcctgattccagtgaacgcttctgctgaaattttgtgcatcggcacagagattctgcttggaaacattgtcaacaccaattcgcgggagatttcctgcgggcttgcggagcttggcgtcggcgtctaccggcacacggttgtcggggacaatcccgagcgcctgcgcgaggcgctcgccgcggcgtttgaacgcagctccattgtgattacgacaggcggccttgggccgacctacgacgatttaagcaaggaaacgatcgccggttatttcggcgtgccgctggagctgcacgagccgtcctccaggcacctgcactgttatttccataaggtgggccgccagatgacggaaaacaacctcaaacaggcgatgatgccgcgcggctgtatcgttctggaaaaccacaacggcaccgctccgggcgcgattgtggagggcggcgggaaaaccgcgatcatgctgccgggtcctccgcgcgagatgctgccgatgttccgcgagcaggtcatgccctatctggctcgccgctccgatcatgtgcttgtatcgcacagcattcactttttcggcatcggcgaaagcgcgctcgaagcgcagctgcgcgatgagatggagcggatggagaacccgacgctcgcgccgtatgccaaggacggcgaggtgatgctgcgcgtcacagcccgcgcgcatacaaagcaggaggcggaggagatgaccgcgcctgttgtgcagtcgctttgcgagcgtttttcgcagtatatttatggcgtcgatgtgggcgatttgcagacggccgctgtgcgcgcgctcacggagaaggggttaaaggcggcctgtgctgaaagctgcacgggcggctatgtatccaagcggctgaccgatgtgcccggctgctcggccgttttcgactgcggcgttacaagttatgccaacgagatcaaggaacgcgtgctcggcgtcgcgcgcgagacgcttgcgcggtatggcgctgtctcagaacagacggcgcgtgaaatggccgacggcgtccggcggctggccggggctgatatcggcgtttcgacaaccggcgtcgccggacccggcggcggcaccgaagaaaagccggtggggctggtgtacgtggcggtgagcagcgagtggtacagcgatgtgaaagagcttcgtctcggacgcgggattgagacgggcgagcgcgattatatccgctatattgccgcgtcgcacgcgctctccatgctgctggaagccgctgcgaaaaaaccgtgagcggcgctatgccgtctggcgcgtccgccgcgcggcttgtccatacgattgcgccggtctatgacgcgcgctcgcgcgtgctgctgctcggcacctttccgtcgcccaaatcgcgcgcgtccggcttcttttacggccatccgcaaaaccgtttctggcgcgtgatggcggctgttttggacgtacctgcgccgcgttcgaacgaagaaaaagccgccctgatgttaagccggcgcatcgcgctgtgggacgtgctgcaatcgtgcgggattaccggcgcaagcgacgcgtcgattaaagacccaaagccaaacgacctttccccgattctgcgcgcgggcgatatccgtgcgatttttacaactggaaaaaaagcatttgatctatacgaaaagtatataaaatctgcgacaggcatcccggccgccgccctgccgtcgacaagcccggccaactgcgcctgttcgttcgaccggctgtgcgaggcataccgggtcatcctgccgtatttggaggactgattatcaatggaacgaattgcaagcttttccgtcgatcacaccaaactgaaacctggactttatgtctcgcgcgtcgacggcgatgttgttacatacgacatccgtatgcgcagaccaaacgccggcagttatctttccaatggcgtgctgcacacgtatgagcatttattcgcgacgtacgtgcgcaacacgtcctatggcgaccgcatcatctatgtggggccgatgggctgccgtacaggcttttattttctgacgcgcgacagcatttccaggcaggaggtgatcgatctgctcaagcagacgttcgcttttatcgcgtcgtatgagggcgagatccccggcgcggccgaggcggaatgcggaaattaccgcgagcacgatcttgcgggcgcgcgcaaagccgcggaggaaatgcaggcggtcctcacagactggacgccggaaaaaatggaatacgaggcgtaggctgtgacacggcgggagctgttggagcgctgcttatgctttccggatgtttatgaggatcagccgtttgaggacccgaactggacggcggtgcgccgatgcgcgaaccggcgctgttacgcgcttgtttttgaacgtgacgggaaattgtgcctgaatctcaaatgtgagccgatgcaggctcagttctggcggcaggtgtatcctcaggtggcgcccggctaccatatgaacaagacgcattggaacacagtgacgctgaacgcgggactggacgacgatgcgctcgacggcatgatcgcccacagttatgatctgacggccccaaaggagaggaaaagacgatgactccacaggattacgaggccctgcaggcgcgcctccgatcgttggcggatccggcctatcaggcgtttcagcaaaaactggtgcctgatgtgacaaacctgctcggcgtgcgtgtcccggcgctgcgccagctcgcgcgcgagctggttcgcggcgattggcgcggttatcttgaggcggcgcgccacgacacctatgaggagacgatgctccagggacttgtgctcggctgtgcaaggatggagcagaacgagctgtttgcgcgtttggcggcgtttgtgccgcacattgacaattgggctgtctgcgacgttacctgcggcggtctgcgcgccgtgggcaaatgccgggaacaggcagccggttttttgacgccgtatctgtctgcgccgcgtgaattcgacgtgcgtttcggcgttgtgatgctgatggaccattttatcgacgaagcgtatatcgaccgtgttttggaatggttggccggagtgcatcatgaaggctattatgtcaaaatgggcgtggcttgggcgctgtcggtctgttttattaaatttccgcggcggacagccgttctgctggaaagcgggcggctggatgaacagactctgcgtatggccgcgcagaagctgcttgactcaaaccgtgtcggcgcggaagtaaaggcggagatccgcacgcggcgcgctgatcggaaaaaaagtcaataaaacggaaacaagcgggccgttgcgacgcagcccgcttgtttcactatataagagtgtggaagagagaagtaagcgcgattgttacctgtccgatactacaataagtatagcataattttccaaaaatgcaagccctatatgtgaaaatgaaccaattttatgtggatgaataccctgaaaagctggtggaattgatgtacagcgaaaggagttttcagtatggaacaaaacgaagccctcaagcgcatgattggcgaaagccgccggattgttttctttggaggagcgggtgtgtcaacagaaagcggcattccggactttcgcagcgcggatggactttacagacaaaaatggcgttatccgccggaaacaattgtcagccatacctttttcatggagcgccctgaggagttctttgcattttaccgggagaaaatgctcgcgcccgacgcgcgcccgaatgcggcgcataaagccctagcgcatctggagtcggaaggaaagctgacggctgtcgtcacgcagaacatcgacggcctgcatcaagccgcgggcagcaaaaatgtgctggagctgcacggctcggttcaccgcaaccattgtatgcgctgcggaaaattttacgatttacacgcggttctggacgcaccgggcgtgccggtctgttcctgtggcggcacgatcaagcccgacgttgtgctctatgaggagcagctcgacgagacggtgctcatgggtgcggtcgaggcgctctcccaggcggatcttttgatcgtcggcggcacttccctggccgtttatccggccgcggggcttgtgcgctactgcaaaggccgccttgccgtcatcaatatgtcgcccacgccgctcgacgcaggcgcggatctgctgattcaggcgcccatcggcgaaacgctcaaagatttttgacagattatgccgcgtaaaacctgattacgcagcgccaaaccggctgttcgcggcgcagcctgtatcaacgcagcgccaaaccggctgttcacggcgcagcctgtatcaacgcagcgccaaacccactgttcgcggcgcagccgattaaagtttttcgccgaggccttttttcaaaaaggccggcgcgcagccgattaaagtttttcgctgaggccttttttcaaaaaggccggaaagcggggaagaaattggaggaaatgggacactgtatatacagaggggcggtttgccccggaagggaagcataaccatgaaaaaacaagctgctattttgctcgccgccgccctgctgctggcaggctgccagccggcggtcccggcaagcgcgccggtgcagccgggcgcttcgtctgtcgcgggcgcggcgccggaggcgacggcacccggcgcgtcagagcaggcgccgcaggaagcgccgcctgccagcgcgtctcagtcctcgcagccgcctgccagcgcgccgcagccggatacgccgccgcaggctacggccggagcgatcacgctgccggaatcaatcgtggaaatagccgcggacggctacacggccgaggcgctgacgcccgcgcaatatgatctgaatttcccgctcaaccgcggcggattccgtggctttcaaacgtgcgagttctttttccttgggcagaatggaaagcttgcagtggccaacgccaatggcaagctgttgacagagccgctttatacatctgcgctggaggggtggaatacctttcatggggtaatcccgctgacgctcgacggcaaaaccggtgcgattgatatgtcggacggcacgcagctcgcgccgtttgaatatgacgacgtctggtcggcgggcggcgacggcggcggattgatacaggtgcagaaaggggatcaatacgaaatcatcgaccgcgacggcaattcacactattcatttgagcgcggcgacgacttctatgtgctgggcaaacgccatatcctgtttaaggatggaatgctgcgtatttattcgaaggaataccagccggtacagaattttgcggttgaggatatgcagatcgtctcctggagcggctcgccaaattattcagggcgcgacctgctggcggtgcagatgaacggcgtatgggccttgtgcgatacagacggcaaaatgctgaccgatcctgtgtatgaaagcatcggatcgtttaccggcgattacgcgactgttgtgaaaaacggaaaatacggcgtcatcaattacaaaggcgtggaagtcatcaagcccgagtgggaggagctgtatctttatgacggcagcgtaagcgtcagcaagaatggccgttggggcgcgattacagatatcgacagcggcaagatgtcaattgatccggtatatgattatgtttcagggtttggcgattatggatatgcctgctttgaaaaaggcggccgctacggcgtcattgaccgcaacggcaacgaaattgttccggcccgttacgacggtgaggttttaaccgacggcgcgaatctggacaaggggtattatctaatcaatggcggcgacggtccgtattctagttcgattgtggagggcgacgggcgtgtgattatcccgtccgaccattttattgtgccggggcaggacggtgaaaaatataacctggtgctcactccatcgggcaagtggggatatgcggacgaccgcggccgtctgctgatcgacgcgcagtacgacaatgcagacgcctttatcaaaggcaaaaatgttgcatttgtccagaaggatggaaaaatctgcatgatcgaccgcaagggcaacatagtcctgcaaacggtgttcagcgacctgatcggctataaccctgacacaatggtgtgcgcaatggaatacacagacgcctccggcgctgtaaagggctgtcttgtaaagatcggcctgccggaaaaatcatagcgatctgacaaggacgctcggcccgtgcttttgtgcggccgggcgtctttgtgcggcgtacacattgcaaatgcacgcgttttctgggataataaccgcatagcggttattatccgctttatggccggggcgatacgcgggcacggcccgctgccgccccaatggccaatgcagccaaggccgcgcagcggcatggctccataaccgcatagcggttattatccgttttatggccggagcggcagcgtattccagacggatagaatgcgctgtcatccgtatcaaaatattggagggaacacgatgcaggcacaagccacaacgaaccgcgaggcggatttgcgctatctgcggctgctggccaggcaataccccaccgtgcaggcggcaagcagcgagattatcaatctccaggcaattttaaatttgccaaagggcacagagcatttcatgtctgacctgcatggcgaatacgaggcgtttttacatatcctcaacagcgcctccggggcggtgcgcgaaaaggtggatgccctgtttgaaaacgtgatgtcgcgcgacgaccgcgcgcggctggcaaccctgatctactatcccagagagaagctggatgaaatgcgcgagagcgtggaggatcttaacgaatggtataagctgacgctgcaccgcctgattgagatctgccggctcgtcacatcgaaatacacgcgttccaaggtgcgcaaggcgctgccgccggagtatgcatatattatcgacgagctgctcaataccaattacgaggtccataataagaaggactactatgaaaatatcatttctaccattattcacatcgaccgcgccgaggattttattgaagctgtatgcggtgtgatcaaaacgcttgttgtcgaccatctgcatattgtcggcgatatttttgaccgcgggccgcgcgccgatatcattcttgattccctgatggagcatcattccgtcgatattcagtggggaaaccatgacgtgctgtggatgggcgccgcgacgggcagccgcacctgcatcgcggccgtgctgaacaattcgatcacctataataatcttgaagtcattgaaacaggctacggcatcagcctgcgtccgcttgcgctgtttgccaatgaggtttatcgggattccgacacctcgtgctttcagacgaaaatattgggcgacgccatcgcctacaacgccaaggacatcgagcttggcgcgcggatgcacaaagcgattgcaatcatcctctttaaactggaggggcagattatcaggcgcaatccggaattcgggatggacgaccgcctgctgctcgataggatcgattataagcgcgggaccatccaaatcgatggcagcgaatatcagcttgtgcacacagactttccaacggttgacccggctgctccgtatatgctgtccaaggaggaggagcggttaatggagcagcttcgcgacgcatttttacacagtgagaagctgcaaaagcacgcgcgtttcctctattccaagggcgggctgtacaagtgctacaatggaaacctgctgttccacggatgtataccaatggaagcggacggatcgtttatgtcgttttccatcggcggcgcgcctgtcagcggccgggcgtttctcgaccgtgctgatctgctggcgcgtcagggctattatgcgcgggaaggcacgccggaaaaacaattcggcaaggactttttatggtttctctggtgcggacgcaactccccgctgtttggacgcgaccatattgcgacctttgaacgctgcctgatcgccgatcatgccgcatgggccgagccaaaaaacgcttattatgcttactataacgacgcggacgtctgcgtgcgcattttgcgtgaattcggattggaagggccgcactgccacattataaacggccatgtgcctgttaagacaaaggagggcgaaaatccggttaaggccgggggccggctcattgtgattgacggcggtttctgccgggcttaccagccgacaacaggtattgccggctacactctgatttataattcctggggcattcggctggcatcgcatgagccgtttgacggccggcttgacgcaatacgcaataaccgggatattgtatccacatcagtcgtatttgaacggatgcagtcgcgtatcaaaattggggagacagatatcggcgcgcagctcagccgcaatatcgaggacctcaagtggctgcttctggcctataaaacgggcgagatcaaggaggatcacggcgggtaaggcgtgaggatttcttttttcgcgcagacgcttgacttttggataaaagtaaattacaaaaatcaacattgcattttgtctgcaaatttgctatacttaacaacggttcaaaaggactggatttttttgtaaaaattcattggggggctatatatgccagctagagtggttgtcggcgtccagtggggcgacgagggcaaaggcaaaatcatcgacatcctcgcgtcgcgcgccgacgtagtcgtgcggtcgcagggcggcaacaatgccggccatacggtcgaaaacgggggcgaggtctacaagctccagctgatcccgtccggcatcctctatccggacacgctctgcctgcttggcagcggcgttgtcatcaaccccaaaggtatcctgggagagatcgacggccttgaagcgcggggagtttcctgtaaaaacctgcgtatcgatccgcgcgcgcatgttatcatgccgtggcatctggagatcgacggtctgagcgagaaaatgcgcggcaagggcgagatcggcacgacaaaaaaaggaattggtccctgttatatggataaggctgaacgctccggactgcgcatttatgacctgatccatccggatttgttcgcgcaaaaggcgcgggccgccggcgaattgaaaaaccgcctgattaccggctattatggcggccagccgcttgatctcgacgcggtcattgcagaatacacagtctatgggaaacgtctggcgcagtatgccgcggatgtttccgtactcgcataccgtgccatccgtgagaataaggaggtcctgttcgaaggcgcgcagggcacgctgctcgatatcgattacggaacttatccgtttgttacaagttcacaccctgtttcgggcggcgtatgcgttggcagcggtgtcggtcccacgctgatcgacgaggttgtcggcgcggccaaagcgtatacgacgcgcgtcggcgccggtccctttccaacggagctgctcgacgaaaccggggatgaaatacgcaaccgtggccatgagttcggcacagttacaggccgtccgcgccgctgcggctggttcgacgcggtaatcatgcgccattccgtgcgtatcaacggcctgaccgcgctggcgatcaacaagatcgatacgctttctggaatgggtccgctcaaggtgtgtacggcttaccgcaaatcagacgggacgatcctgcgcgatttccccgccaccatcgaggagcttgccgagtgttccccggtctatgaggagcttgatgggtttgacggcgacctgtccggctgccgcagtttcgacgagttgcccgagtcctgcaagaagtatatcgcagagctggagcgcctgtgtgaatgcccgattacgatggtcggcgtaggtccgtcccgcgagcaaaacttggagcgtatctgaccctccgcctttttgggaaataaatgcatcgaaaaaccttccgcctttttaaagaaaaggcggaaggttttttactggggctttctaaacagttggagcttgcaggatgcgcgccagccgcgcggcgtctgtcacttctcctgctggcgaaaggccccgcttctgaataggtgtcttgcggcctgcgggccgcgcttttatgagggctgcggcccaggataagggcgctgccctcgaaaaaaggcaagacccgcgaggggccttaccttttttctcacccgccgccttttgaaaaaggcgggcgaaaacttttgtttgcgatgcgccaatccttctgttcgcggcgcagccgactaaagttttttgccgagctttttttcaaaaaagcgggggcgcagccgactaaagttttttgccgagctttttttcaaaaaagcggggggcgcagccgactaaagtttttcgccgaggccttttttcaaaaaagcgggagaatcagaagcgttcgacggaatccttggagacgcgcgcgagtatgagcttttcaggggcgggctgcttgtcggagaaggtgatggcgtcgagcaggaggcgttcggcctctgggagcgcggactgctttgccgtgtaaaggcgcgcgatcgtctcgccgcgcgtgaccttgtcgcccgttttcttcacaagcacaacgcccgcgctcatgtcgatatcgtcctccttgctctcacggcccgcaccgagcgcgacggacgcgataccgcacttttccgtctccatgtgcgtgatgtagccgtctgagggcgacttgacttcatatgtgaccggggcctgcgggaatttggaagtgtcgtcgatcacggaaacgtcgccgccctgcgcaatgaccatcgcgcgcagcttttcaagagccgcgccgctcgaaagcgcgtcctcggcgagcctgcggcattcgtcgagcgtgcccttgtccgccagataaagcatgttcgccgcgagctgaaggcagacctcggtcagatcggcaggaccatgccccttcagcgtcgcgaccgattcggccacctcgagggaattgccgatcgcatggccgagcggcaggtccatatcggtgatcagcgcgatggttcgccgtccgttgcgctcgccgatggaaaccattgcctgcgccagcccgatcgaatcgtcgagcgttttcataaacgcgccgctgcccgtcttgacgtcaagcacaatcgcgttcgagccggcggcgagctttttgctcatgatcgacgaggcgatcagcggcaggctgtcaaccgtggcggtcacgtcgcgcagcgcatacagctttttgtcggcgggggcgatgttgcctgtctgaccgatgacggatagacccgcgtcgcgaacaatctggaaaaactgctcctgtgcaacagatacgcgaaagccggggatcgactcgagcttgtcgatggtgccgcccgtgtggcccagaccgcggccgctcatctttgcgaccggcacgccgcacgccgcgacaatcggcgcgatgacaagcgtcgtcttgtcgccgacgccgccggtgctgtgcttatccaccttgattccgggaatggccgacaggtcgaccatatcgccggagcgcgccatgcagtctgtcaaaaccgcggtttcatgctcgttcatgccgttaaaccaaattgccatcaaaagcgccgacgcctgatagtccgggatatgaccgttcgtatagccgtcgatgaagaatgcaatttcctcgtctgacagcacgccgccgtttcgtttattcataatgatatcgtacatgcgcataattgcaagccctccctatttcatctgtagttaccgcagaatctggccgcagagcgacacgccgtcgcagccagccttgacgccgagcagcgcggcggctgtttcgcccgtgtcggcaaaggtcggccgcgtgcccaggtcgacgcccgcgcgtatggacgcgccgtaaatgagcagcggcacatattcgcgcgaatggtcggtcgacgccgtacccggatcgcagccgtggtcggctgtgatcatcagcacatcgtccggaccgagcagcggcatcaattcgccgagacgctcgtcaaagcggttgagcgcggccgtatagcccgggatgtcgttgcggtggccatataccatgtcaaagtcaacgaggttgacaaagcaaagcccgtggaaatcggagcgcgcatgcgcgattgtttggtccatcccgtcgtcattgttgacagtgcggcttgtcctggagatgccgcggccggcgaagatatcataaatttttccgacgccgatggtatccagaccggcctgcaaaagcttgtcaacaaccgtgtcgcgcggcggctggagcgaaaaatcgtggcggttcgaggtgcgcttgtaggggtattcgccttcaaacggacgcgcgatcacgcggccgacgccgtgttctccgtgcaggatttcgcgggcgatttcacagtccttataaagctcctcgatcggaacgacgctctcatgcgccgccacctggaatacgctgtcggcgcttgtatagacgatcagtgcgcctgtttttacatgctcgcggccgtagtcgcggatgacatcggtgccggaatagggcttgttacagagcacccggcgtcctgtgcggcgctcaaactccgagataatctccggcgggaagccgtcgggataggtcggcatcggcttttttgagatcagccccgcaatctcccagtgtccgatggtcgtatcctttccggccgacgattcctgcatacgtgcgaatgaaccaatcggcgcgctgaccgcctcgccgcagccaacgccttcgatgttaaaaagccccagcttttgcagattgggcacatgcagatttccggagcgccagcaggtacgaagcgtattgctgccaacgtcgccgtaatcagcggcatctggctcctcgccgatgccgacgctgtcaagaacaattaaaaaaacccgttttgccatgctgattgatcacgcctttccatcagatattgtcaatggaaaacagcttatccgccaaaggcccgcgcttgtttttgcaggttaaaagagcggcggcatactggaaaattccacaagcgttttcctgattataaaacgatacaactttattttaacataaaaaacaggtggatacaatgacaaacggccctttcagcggtgctctacgccaaaaaagccgttggttttttgtgaatatttaacatgagatttccctgcacgccccgcatcctctttgacgccggccagcccagagattctattttttaaggaaggcttgaggggagattgccgcagtagcggtagctgtgcaggtaatcgcctttggtaaacgcctcgtttcggcttgtctgggctggatcggtgaggtcgccggccagcttttgcagatttgtgcgcgccgttacagcgcagatatgcgcgcttgacgcataggcgacgacgccgttgagcgtgggcgtcgcgccgaacggcgcatagatcgcggcgcgcacattcggaccttcgtccggcccggcggcatagcaggcgtatagcgcataaacgcccgcttcattcgcgcggcagcgcagcagatcgggcatgatcccgccgcgcgcgtcgggcacggcgatcaggcgcgcgcctttctccgcgaggattttgaagcgttcaaagtaataggcgtccgacccgatgacaacgccgagcggaccaagcggcgtgtcgatcggctcgaggacatcggagggcgaaacgccggcgtcgttgtcgaacccgagcacgcttgtcttatcctggacgcccgcctgttcgccgtctgggccgaacacgatgcatcggttgaccaggcggccgtcctcctcgcggacgagcgtcgtgccggcgaccacataaacgcgaagcgtacgggcgatcccgctgaaggcggtctgatacagctcgtttaaaaagccgccgaaggtttcaagcacggcagccatgcgcaccggatcgggtgccgcgccgtccaaaccgatgaaatgcttcccgtgcagcacccagttgagaatctgcttgctcaggggcagcatggtcagagcgagtacgcccacatattccggatacacgacaacctgcgcgccggcgtcgaccgcgtttttggcaagcagatacacttcgtccatatagtcgcgcagatccttatatgcgcgcgccgtcaattggacggacgcggcgcgcaccgcctccggcgcagcaaattccgcgttgttttgggcggcgccgcttttttccgaaagcagcgcgtcgatttttttcggggtcacccgaaacgacatccaaaaagaaatcagcggcagcagcacttcccacatgccttttacctcccaagctcggcttcatagtttgcgatcagcgcgggattgatctgttccaaaagccgcagacctcgccggatttcatcgagacgcgccatattcagcccaaaacgcaccgggaaagaggaggtctggcggatcagatacccgtcgcccgcgcgtgtcacgcccgccggacatgcaaccgcggcgctgcccgccgcaatgttgaccacatacaggttgttgccctgcgcgccgctccacactgtgcgcagcaggcgttcgcccgcatcctgcaccgggtcgagcgcctggaccgacagtgcgacgtccgcgcccttgagagcggctgcacgcagcacgcgcggatcattgatgtcgcagtccacgcacaggcacacatttccaagctcgccgacgtgcgccacttcgatgcggtcgccgggcagaaactccccctgaaacgaaatggacggatggatggccggctggcggcagaccacctcgccgcccggatcgagcaggcacaggcagaggttgccctcgtgcgcgaacaggcccgtcaatacataaacgccgtgctttttggcgtatttcacacaggaaaacagatgccgtttgacatcctcaagcgcgcggtgcagcgagccgtccgcaatcaacaccaggcgcgcgtcgtccgagggcggcataaacggccgctgaatctcgacaaaatagctgtccatgtcgttcccttcctgaagccgccgtccggggcttccatcaatgttcaagtgattttgccgcggacgatgccgcctgcggcttctattatctcatattttacacgcgatgtatagattatttgggcgctgtataaaattggtgttttaaaaaaatgatgaaccgcctggcgccggcgcgaactgcaaaaaaaaacgagccgcacggcccgctgcaaatgaaatgatccggagataaaataaaggaggggggatttcactttagaaacactgcgtttccattgcttattatatcatgcgtgtgctggaagatggtgaacaaattgtgaacagacacaacatcttgtgccctattggcgaccgcgccgcaacttttggaaaaacgctgagagaatctgcgcacactcctcaccgcgcacaccgcagacgacctgcggcttatgattgaaggcgagcgcgttgaagtcgcttactgagccgaagcagccgctttttggatcacgcgcgccgaacaccagccgccggatgcgcgcattgataatcgcaccggcacacatcggacaaggctcgagcgtcacatacagctcgcaccgatgcagccgccagccgcccagccggcggcaggccgcgtcaatcgcctcaagctcggcgtgcgcgagcgcatttttcccggtttcacgccggttaaagcctgtcccaacgatctgtccgtcacacacgacgaccgctccgaccggcacctccccgcgctccgccgcgcacccggcaagccggagcgcctcgcccataaaatcattgtcattcatccgtttcagccgtcctcccgctctcaggctcgcgcaaaccgtttggccgcccggggacatgcgcttttttgcacatgccgcagcgtgcctgccgcatccggcatacctgccgtccggcccctcagccggttcatctcaccggcgtatagtcgatctgcgaagtctcgctggtcgattccagcttaaagatgacgggacgaaggccgtcgttgcagctacagatcgcaacacctggttttctgatccagtcgccgtaataaaaaatatgttcgccggccccgtgcgcaagcgcaaacacatactggtaaacagccttccaggcttcatcacagaagccggccggcttggcatagtcggcgtaaaagacctgaccctcccgcagcattggacaggcggacaagccttcggcgccgtactcacgcgcaagctcctcgtcgaatgtcgtcttgagaacagtgatgcgaacctttttcatgtgattccccgctttccgtgaccggcgtcaccgtcagccgccgtctgttttgtatataatagcataaatcttccacagatgcaaaatcgcccttcccttttctacaccgttcctgtataatattacctaataatccacaggaggaatcatatgcagagcttactgacaggcgagcacatcagcttcgccctggtttttattgaaggactgttgtcctttttttcgccgtgcgtcatcccgctgattccgatttatgtcagctatctggcgggcagcgccgaccgcgatgaagcgggcgcgccggtctatcaccgcggccgcgtgatgctgcataccgtcttttttatcctcggcgtatcattcgcgttttttctgctcggactttcgtttacggcgatcgggacgtttttttccgggcataaaacattgtttgcgcgcatcggcggcgttgtgatcattttgcttggccttgtgcagataggctttttcgagctgccgtttttgcagcgggagcggcgcttccatctgaatatgaagggtaagcggatgaatccggttgtggcgtttgtgatgggctttacattttcctttgcctggacgccgtgtgtcggcccggcgctttcatctgtgctgattctcgcctccggcgcgaaaagcgccgcgaccggcaacctgcttgttttgctctatgcggccggctttgtcctgccgtttctggcgcttgggctgtttacaacgcaggcgctcaatttcctgcgcagccacaaaaagctgatgcgttatacgatcaagacgggcggcgcgctgctcatcctgatcggcgtcatgacgtttaccggttggatgaacggtgtcactggctatttaagctcattcggcgcgccgtccgtttcagatggggaagcggcctccacctcgtcctcgcaggccgcgccggagcagtcgggcccgtccgaggatcccggcgcacaggcgccgtcctcgtccccggcgccttcctcctcctcgcccgagcaggccgatgtcatcccggcttttgactttacgctgaccgaccagtacggcaacacgcacaccctgtccgattacaagggcaaagttgtgtttctcaacttctgggcgacctggtgcccgccatgccggcaggagatgcctcacatcgaggagctttacaatgaatacgggcaaaacaccggcgacgttgtatttttaggtgtgacaaatccaaagacggatgaaaatccatatgggcaggatggctcgcctgaggaaatcgcgcagtttttaaccgacaacggctatacgttcccaagcgtgtatgacacgacgggcagcgtgttttccgattattttatcagcgctttcccgaccacctttttaatcgacgcgcggggcaatatctttggctacgcgccgggggcgatgacaaaacagatgatggaaaatgtcattaaacaggtgctcgacgcggcgccggaggacggggcgtcgtcttccaccgcatgaggccctgtcgttttgcaggatgccggaaccgttttttcaaatcgatttaaagcaataaatttttggaatccgttgtttttttctgtttcgtatgctagaatgacattgttttccactgtgcgctatcatttcgggccgctgcgcggtcttggcgggaggcgctttcagggcgatgtcaaacagctttaccagggggctgcgggcggctgcggccgcgaccgcgccgattcttttcggatatgtgtttgtcggcatggcgttcggcctgctgctgcaaaagacaggctacggcgtgctgtgggcctttttgtcgagcctgaccgtctattccggttcgatgcagtttgtcttggtcgaactgctcatgggctggccaggctttttgcatgtggccgtcgtgacgcttgcggtccaaatccgccatgcgttttatggcctgtccctgatcgaggcgtttaagggtctgggaatcagaaagctctatcttatttttgcgctcaccgatgaaacctattcccttctttgctcgatcaagccgcctaaagcgatgccgcggggccggttctatctgttgatcgccctgctcaaccagtgctattggatagccgggagtgtgatcggcgcgacggccggcgagctgattcccttcgattctacaggcatcgattttgcaatgaccgcgctgtttatcgtcatttttgtcgaacagtggcttaattcaaaaacgcatattcccgccctgacggggcttggatgcgcgctggtctgccttgccctgtttggaacggacggttttctgccgccggcgctgcttttgaccgtcggcgctcttttggccggccgccggccgttggaaaaacgcctgaatggttcgcaggagggaggcggtgcggtatgccgctgacgccgcttcaaacgcttgctgtggttcttacggtcgccggcgtcaccgtactgtgccgtgcgcttccgtttttgctgttcagagacggccgtcctgtttccggcagggtgatctatcttggacgcgtgctgccgtatgcgatcatcgcgatcctggtggtctactgcctgcgcggcatcgattttgcatccgtccctttcggcgcgccggagatcatcgctgtcagtttgacagttgcaatccatgtttggaaacgcaacaatctgctttctatcggcgtttccacgaccgtctatatgcttctgctccggcttttctaaaaggtccacgcgcttaaaatgcgtcaagcaggcgctttggcgcgcgcgacccgtgcgcgggccgctgcgcttgcccggccggctattcggggctttccggcgctatcgcgccgggcgcggacaagccgcggcagcgctccttttcgcgccttatgggacaggggcgggctggccctatcccgtggacacaactccggggcaggcgcagcctgtatacgcgctgcgtccgccccgcagttcgcggcgcaacctgtaaaaataccgggacctgtcccactgtttgcggcgcagccgactaaagttttttgccaagctttttttcaaaaaagcgggggcgcagccgactaaagttttttggcttacctttttttcaaaaaaggtaagaagttttttgccgaggctttttttcaaaaaagccggacaaaatagaccatgtcggtcagcaggacgccgtcgtcccatatgggctgagggtagttgtcggtaaagaaatttttcacgcggtgggacagcgtaaagccgcacgcgctgtaaaacgcgaaggatgcgggcgtttcgcccgtgccgaccagtacgcgcgtgccggctggcaggcgtgcgagcgcggcgtcgatcagcgcgcgtccgacgccgcgccgctggaatgccggcgcaaccgcaatgtttttcagttcccagccgctttcgacgggcacggcggacaggacgccggcggctgcgccgccttcatgagcggccagcagaaagccggccggcagatagcggccgatcatttcttcggacggatcggcgagcaaaagcaggtcgcggtatgcccatcggtcgcctgatacttcggttattttcatgatcaaatcccccgatctcttatatatgagcagtctcatcataacgtggatgcggctgtacgtcaacggcgcggggcaaaataagatacaggggatgtcagtcccgggaggagcttatgaagctggtttcatggaatgttaacggcctgcgggcctgtttggggaagggattcctcgactttttcagcgcggcggacgcggacgctgtctgccttcaggagaccaagatgcaccaggaacaggccgatctggagctgcccggctatcagcagttctggaacagcgccgaaaaaaaagggtattccggcacggctgtttttacgcgtgtgccgccgctgaatgtaacttatggcatcggtatggcggagcatgacagcgagggacgcgtgatcactgtggaatacgaaccgttttatcttgtcaactgctatacgcccaatgcgcagcgtgagctggcgcggctggagtatcggatgaagtgggaggatgattttcgcgcatatcttatgtcgcttgacgcgaaaaagccggtggtgctgtgcggcgacctgaatgtcgcgcaccaggagatcgacctgaaaaatccgaaaacaaaccgccgcaacgccggattttccgacgaggaacgcgccaagatgaccgagctgctcgcgggcggttttgtggataccttccgggcgctttatcccgacgtgactggcgcatatacctggtggtcgtatctgcgccgcgcgcgcgatacaaacgcgggctggcggatcgattattttatagtctccgaacgcctgcgcggcgcggttcatgacagccgtatccgcgcggatgtgatgggcagcgatcactgccccgtggagcttgatttgctttgaggcgtctgcaatctgcttttaaatcagaaaagaggttcctgcatgaagattggccttgtcctggagggcggcggtatgcgcggcctgtatacgaacggcgtgcttgactgtatgatggacaacgactggtatccggattatgtaatcggcgtgtcggccggcgcgtgcagcgccgtgtcgtatatctccggccagcgcggacgcagctaccgtatcaatactggatatttaggagataaacggtatgttgggctggacagcttcatcaaaacaaaatccatgtttgggatggattttatttttgatgaaatcccgaaccgccttgaccctttcgactataaggcgtttttagcctcgcctattgaaatggttacaggggtaaccgatattgaaacaggtatgcctgtttactttgacaaatcggccgtttcgccgggcgacagcacgttgtggcgggcttcgtcgtcaatcccgggcttttcgccggttgtatcgtttcgcggcggacgttacctggacggaggaacaagcgacccgatcccggttcgccgcgcgcttgccgatgggtgcggccgccttgtcattgtgctcacgcgcgaccggtcctatcaaaaagcgcccgagcattttcggacgctgtatcaccggatgtttcgcgagtatccgcagttggcgcgcgcgctcgaccgacgccatgaaatttataatgaaacgcttgattttatacggcggctcgagcgcgatggtacggctgtcgtcatcgcgccgtcgctgcccgttgaaatcagccggtttgaaaaggatttgcggcgtcttgaaagcttgtataaatccgggatgctcgacgcacagcttgctatgcgccggctgcacgctctgaaatagcgggaaaggggcaatctgcatgacatatctggtgattggagccggcggtgtgggcggctgcatcggcggttatctggcggacgcgggatttgacgtaacgctgatcgcacgcggcaggcatctggaagcaatccattccagggggctgcgcctgtataatacgcgccgcggcgacgagctgtgcgtccatccaaaggcgtgcacggccgatgaatttaccggccgtgctgatgtgatatttgtttgtgtcaagggatattcaatcgatgaagtcgtgccgctgatcgaccgggcggccgacgcgggcagcgtcgtcattccggtgctcaatatcgtcggcacaggcgaacggcttgcaccgcgcctgcctggacgcctggtgctcgacggctgcatttatatcggcgcatatatcagcggtccgggagaagtcacgcagaccggcgatctgtttcgcatcgtttatgggcagcgcgatacagatgagccggacgggcgtctcaataaaatcgccggcgagctgcgtgacgcaagcatcgatgttgtcgtttcggacgacatccgccgcgacgcgtttcgcaagttcatgtttgtatctccactggctgcggccggcgcttattatgatatgaccgccggcgagctggccgcgccgggaaaaggccatgacctgtttattgagcttatccgcgaactccaagccattgcggataagcgtggatacagattccctgacgatatggttgaaaattcgctccggcgtcttgacgcgctttcccctgacgcgaccgcgtcgatgcagaaggatcttaaaaagggcggcagcagcgagattgacggacttatctttgagccggcgcgcatcgcgcacgaactgggcgtcccagcgcccgcctatgaacagctttcccgcttttttgaaaaaaagcttggcaaaaaactttagccggctgcgccgcgaacagtagggcgggttttggaattctaccggttgtgccgtaaagagcggggcggcccggccgcccctaccctatgaacccaaccccggggcgggcgcggcttgacggtttaccgcagaacgtacaggcgtgcgcccgaaaaatccgtgccaaacagtggtggggataacacaaggggagtgtcgggcgacactccccttgtgaggcgtggaaaggggcgcagtcgccgcttggacgcgcccggcgttgtagcgccggaaagcaccgcatagccgaccgggcaagcgaagcgcccggcggtgagcggcccgcgcatgggctgcgcgcgccttagcatcagtttttgcttttgggtttaaagatcagggccatgatcagagagaaaaagatggcggcagcgatcccggcggctgtggcgccaagtccgccggtcaatacgccgagcaggccctcctcctggatggcctcgcgcacgcctttggcgagcgtgttgccaaagccgagcagaggaaccgtcgcgccggcgccggcgaattcgacaagcttggggtaaaggccgacgccgccgagaatcacgcctgcgacgacatagccggtcaggatacgcgcgggcgtcagctttgtataatcgatgaagatttggccgatggcgcagatcagtcccccgacaagaaacgctttgagcagcgcgatcagaatggtcatgaaacaagccctcccttcttttttgatgaaagataaacgagatgcgcaatcgatgcgatgctctcgccctgctgtaccacagttgtattcatcagcgcaccggttgcgataaacaggatatcgtgcagttggccggtgtgcatcagcggcaggatatgtccgcacatgacggaagcactgcatccacagccgcttgcaccggcgtgtacatcctgtttttcaaggtcatacagcatcagcccgcagtcggtctggcagtgttcaaggtcatagccgtcccgccgcagcaggtcacgcaggatggtgccgcccactttgccaaggtcgccggtgattacaaggtcgtaatcatttggtcttgtgccggtatcgtcgaaaaatcgcttgatcgttgcggccgcagccggagccatggccgcccccatgttgttggcgtccgtgattccgagatcctcaatggtgccgatcgtagccgcatggataaacggcggtgtatcgcctttttcaaggacagccgcacctgcggcggtcgcggtccattgcgcggtcggcgtgcgctggccgccgtattcaagcggcaggcggaactgccgttcagccgtacagaaatgcgacgaggtacatgcgaccgcccggcccgccgcgccgctgtcaagaaaaacagatgcagtcatcaggctttccgccatggtggagcaggccccgaacaatcccacgaacgggatgccaaaggagcgcaggccatatgttgagccgacgcattggttcatcaaatcgcccgcgaacacgcagtcaatgtcggaaggctggtactttgctttgtcaagcgccgtttggatcgcggtctgctgcatacggctttcggctttttcccatgttttttcgccaaagtagtcgtcctcattgatcacatcaaacgcgtggccaatcggtccttccgattcctttttggagccgacggccgcagaggcgcgcacgctgattggttcgtcaaacacaacggtataggtccctttacgctttgccataaacgcccctcctcaatacaatccgaacaggtaaataatcagtccgtatacgatactggcactggtgccgtagacgatgaccgggccggcgattacaaacatttttgccgccagaccaagcaccagaccttcgcttttgaattccagcgccggcgaggccacagcgtttgcaaagccggtgatcggcacaagcgtacccgcgccgccgaatttggcgattttcggatatatattgaagccggttaatatgatcgacagaaggaccagcgttacggaagtgacgctgccggaaacctcctcggtcataccagacgactggtatgccatcataatcgcctgtccgagcgcgcagatcagtcctccgatagtgaacgccaaaagaaagtccttgatgaacggcgatcgcggggagctttgttttgtaagttcgttgtattcctccggtgtcatattcataggtttcatccctcgtttcaagattcatatgctgtgttagtgttcactttccataaaaaaatatcccacgcgcgctgattcaaaaaatgccaatccagaatctggaatagtaaattcagcacatgattctattttgatttgtgtatagataactgttataattaacaattaaaacaaattttagaaaataattgacaaacaggaaaataaaggatacaataaagacgcatcaaagcaggcaaccgacatgaaaagaaggagaggtaaaatgaaaaagcttatttcgggtcttattgtacttgtcatgattaccgcctttatgaccggaagtgtgttcgctgctgctcccggagaacccacagaatcatttgatgcagatacacgggcaagcggtatcacgtatggcccttggtttggaaatgggaatgagagctggagcaccgacataaaatcgctagcttcagccaccagcacaataacaggggcaatatctttttgtttgccgccgagtgccgcgcgatcaattggcggggaaatttccggcgctttatctgcaattgcgattgcctggccggactgttatacatatggcacggttcaaaaggagtatagagaagcgcattattcagatggcaccttcgcctatttccaatcgcattatacggttaaggcatatgccgtgagcaatgggaaaacgacctatttaggcaccttccatgagtattatgaggggtcatatccgatgcgcctgcaagggagtgaatcgatagagctttgaacttacagccgaaaggaaaagcattctcctatatctataaggcggccgcggtactgttggctctgtcccacttttggccgtcgatccgtggaacgcctgctttggttatgactacgtgcggatggctgatgatgattggctggacattttttgaatttttccgggaccgtgagaataaaaggcacgcaaatataagatatctcattaccggcctgattacgtatagtattcttttgtggagttcagttcattttgtattgagaaacaggatgcaatagattgtcttaaagaacacagcttgcctgtgttctttttttatacagcacgcctgttttttgtgtgctgttaaaaataatcagcgcaatgcggcaattggcggcaattgtcttttgcaggaagcaatggtataatgaaactgatttccaacaagctgcaaaaataggaatatagtacaattttggggaatttaagaggtggaagctgtatgaacgagcttgatacgatgaaacgtgcaaagatgtatctggacaagctgtcgagaggaatcgatccgatcagcggttcggcgcttccacttgacggcgtgttaagcaatgtccggttgtcgcgttgctttgcttatgtatccggcattctggagcaggtcatcgaaaacggcgggacggtcggccggcgcaaagcgccaagaaagccgccgttttcgattacgcccgagcaaaaaacgcgcgtgcgcgtgctcgacgaaccgattcctttgaccgggtttgtaaaacaaattaataatgtcacggttctgaccagcgatacacagctcacattcgcaaaggttgccgacggcctggaggagatgggctttttggaaaagcccgaagcaagccgcacccgtgtgccgacgcaagcaggcgttcagcttggcatctcgcgcgaggagcgcaaaaatgaacggggagatacctatctggtgaatctctttaaccgtgcggcacagcagtttgttttggacaatcttgaggatattttggaggcagccgcacagaaaaaggctgccgaaaaggagtaaacaaaacccgccccgcacgctgattggagcgcgcagagcagatattctgaaaacgattcttgccgggatgggagaggattggaatggtacgtgaaattttgcgtcttggcaatccggcgctatagcgccgggcgcggataagccgcggcggcgcgcctcacgggacaggcgcagcctgcatcaatgctgaaaccggcccctctgtttgcggcgcagcctgtaaaaatgctggaacccgccccgctgttcgcggcgcagcctgtaaaaatactggaacccgccccgctgttcgcggcgcagccgaataaagttttttggcttacctttttttcaaaaaaggtaagcagttttttgccgtgcttttttcaaaaaagcgggggccttttttcaaaaaggctggaaagcgggaatgaacaaggagaaaaatgggaaagataatgccatctaatctgtaaaggagacgatggttatgcaaaaaattctcaagggttccaaaacggaagcgaatctgatggcggcgttcgcgggcgaatcgcaggcgcgcaataagtatacattttacggcgcgaaggcgaaggcggacggctttgaacagatcggcaacctgtttctcgagacggccaacaacgaaaaagaacatgcggaaatctggttcaaactgctgcacaacgggatgccggccacgggcgaaaatctgatggaggccgccggcggggaacggtatgagtacgagacaatgtatccaactttcgcaaaagaagcgcgtgaggagggctttacaaagatcgccgcgctgtttgagctggtcgccaaaattgaaaaagaacacatggaacgctatgaaacgctgaaggccaatgtcgacaatgggactgttttcaaaaaacaggaaagcgtcacctggatctgcctcaactgcggccacgtctatgaaggcgcgcagccgccccaggtctgcccagtctgcgaaaagccgcagagctggttccaggtcaaggcggaaaattattaagcggacgctgtctgcgcgaacggcagccggccccggattgtcaatgcaatccggggccggctgccataatactgtacttatgtcgtttatacgccgcaataggcgctgaatccgccgtcgatgggcagtaccgcgccagtaataaagctggcggcaggagagcaaagaaagatcaccgcgcctgcaagctccgcaggcaggccgtatcggcccataggcgtgccggaaataattttgcggccgcgctccgtgtcgcttccatccggatttttcaacaggtagtcattctgctgcgtgagcaaaaatccaggagcaatggcgtttactcggattttgggcgaacaattctgactgaagtaaacggccatccattgggtaaaattggagacagccgcctttgcggcgctgtaagctacggtgtttgtcagcggcgtgaaggctgccattgaggagatattgacgacacagccgcttccttgcttggccatgaaccggccaaagacctgggttggataaatggtgcccatcagattcaggttgagcacccaggaaagcgcgtcacccggaagatcaaaaaagctcagttccgggcttgccgtggcggcaggcttattgccgcccgcgccattgatcaggatatccacgccgccaaaacggttggcgaccgcctgccctgccttctcgatgctttcacggtttaatacatcgcagtaaaagctgaccgcctctgcaccggcgccgttaatctcctgggcaagctgtccggcgcgttcgggcgcgatatccagcagcgcaattttggctccgtgcgccgccagttcgcgggcgagcgtggagcacaaaatgccgctggctcctgtgataacggccgttttacccttgatgtgaaagtttgccatttgaatccttcctttctttgttacatatcagatttgttgataaagggcgtcttgggacctgtattctcagccgaaggacgctggacaggtaagtggcgctcccggtcagggaaaattttacgcggagcaaaggcgaaagaatgatctgcccggcgctggacgactgcggacgcatgttcttaaagccggctccgtccatggctgataaaaagcggcgcaacgggttaatagaccccgtcggccgcatcgaagtgcgtaggcgcggcgattgaggagccgccgtccagtatccactgggcctgccaacgtatcatccgctccaggcaaacagagggatatcccatcaactccatcagttttgatgaattactgaaaattccgccgttctgctcctcgccttcatagagaggggcgcgccccagcagatcgccgaagcgttcggctgcccaacgcgtggagaatgtctccggtccggtcacattcaggacagcgggcggcgcgtccacgtggagcagcgcggtatggcgtattcgcagacatccccttgccagatgcagttgaggacgctgcgtccgagtttgatggggataccgtcccgcacatttttggcgatatcgtacagaacgccataacgcagatcgaccgcataattgagtcggaacatcaggctgcgggttttattgcgcctggcgtaataggaaaacacccgttcccggccgagacaggtctgaccatattcgccatccggattgggcgcgtcggtttccacggatccgccgcagcgggcaggacggtcgccgtagatgtttccggtggagaaggcgacgatgccggcttttggaaaccgttcgcagattttagcggggagcagcacgttggccgcccaggtgtccgcctgatttttataggtcccgaattttcgtcccgccagaaagagaatgttgtccatttccggcagggcgtccagctgctgcgaatccagcagatcggcttctacaacctgcacgccccaatgacgcatggtctctgcggcggctggttcgtcaagctttgagacggcaagaatacgctttgtaagacccgcggcctcgcaggcgcgccgggctgtgacggcgaggctcggccccaccttgccgcccgcccccacaatcatgatatcgcctgaaatcttggcgatgtcatcgatcaggcggggcgaggggcgtgtgatccgttccagcagttcctgtgaagaattcataagagaagctccttttattcagatttgcggcgatggccgccgggcgcgccgtataaagcctttggacgctttggtattgcgcgtttgattaaaaacgggtaaaataaaaaggatcattggacaaggggtgggatggatggcggagaaggacacgaagaagggccgggcgaccatcaaggacgtggcggagcttgcacaaacgagcgtggcgactgtctcgcgcgtgttgggggattcgggctatggcgttaccgcgcagcttcgcaagcgggttctcgcggcggctgaggcgctttcctatgttccttctgcggctgctcaaaagctgcgcggcggcggaagccgcgatattgggctggtcattccgaatattacaaaccctttttatatgcagaccatccaggggatttcggcggtctgttacgaccgaaattatcacatcattctctgcaactccgcccgcagcgttgagcgggagcgcgcgtttttagagcagctttatgcccggcaggtgcagggtgtgatcctctcgtcggcggacgaggagcacagctctgtcgcggattttctgtcccgcggcatgaagtttgtgcagttggatcagcggtttgaacgcgaggagtgcgcctgtatcaactatgattccgagctgggcgcgcgcatggctgtgcggcatctggcggagaaaggacaccggcggattgcgttcgcctctaccccgctgacacgctggacgcgtaaggcggtcctcaagggctaccgcgaggaaatggcggagcagggctttcaggatgaagccgccgagctggtctttatcagcgagcctgtggaagcggtagagagcggcagctatgagatggacgcggggtgcagcgttgcgcagcagatattggaacgccgggcggatgtgacagcggtgttctgtgtcaacgacatggtggcctttggcgtcatcgcggagctgcgccgcagcggcgtgcgtatcccggaggatttgtcggttgtcggctttgacgatatcccgtttgccgagagctttatgcctccgatcacaacgatccgctgtccgtcctatgaaacggggcggctggccgccatgatgctgatcgatcagcttggcgacggcagcaagagcttgaatttaaatatgagcctgcagccgattctgatcgagcgccaaagcgtccgggatctgcgcgggcaggcggaataagaaacttacaaagcaggggcgccgcccctgcttttttgctgtggcgcggcctatcccgcttagaacctgtattcacagtcggaggatactggacaggcgagggattttgtacccgatcaatgcgaatttttgcaggcgggctgccgcccggcaagaaaatttaacgtggagaggggcaaaagacccgcctggacggcgttttacggctgtggatacaggctcttatataagcgggatgggccgtgcctcttgcagagagcggccgattgcatccagcaggcgcgtggaaaataaaagacgctgcgcgccttggccaacaccggattccatcatgtcgcgaaacgcacgcattccgtattcatagcagcggtcgaagtcgccgagcggacagtactcctcgtcccagctgtggaatgtcacggccggctcagtaagcgtgggatcggagtgaagcagaacgcttcggttggggtactgtacaagaacgtccatgagtctgcctgtacgccgcgccgaaaccatttcggctccacagccgcagatcgcagagcacaggtcggccagatggctgccgtaaaagttccagccgccgaagggcgaatcgcaatcggccgcataggagatgataaggctgcggcagtggcgcgcccgctcgcgaagctccgcgatctgtgggagaaagcagagcgtggaaccgccggtcagcggcgtgccgcactgcttggacagattgatcatcgcggcggcgtccggcacgctatcgcaaaacggcttatcgacaaaaaccggcttgccggcgcgcaggcaagccaacgcgagcgccttgtgcgtttctccgcgccgcagcgtgatgatgacgccgtcactgcgttcgataacttcttcgggccggtcacagagcgtttgcagcccgccttccgccatgcaccagtcgacccgttcggggcagtcgccgccccagagggaaacggcccgcatccggggaaacaagggcgaggtgttgatcagggaacagaaaagctcggtgtgtttgctctgcgcgccgatgacgccaatttccatgcgcgtgcctcccgacaattacaatttaaggataggggctgtttgcgaaaaagcaggcaattcctcttttaaataacccccgcctgcggaacaattctcaaggtttctgcttttcattatagggagtaaggtatataaaagtcaatattttggtaaacgttttctaaaatttttcttattttttctgaaaattagcttgcaattttctaaaataatcgtataataaagctagaaacttacaaatgataaacaaaaaattggtgcaattgacctcaaatggtgtattttggctgatttggcaaatgcgcttgttaagaaaacatttactaaatgtgtatcatttcgcatgatggccatgcagaaataaaaattatcttttttaaaggaggacgcacgcaatgaaaaacaaaacgctcgcgggcattctggcagtctgcctcacctttggcgcgctggctggatgttccgccgccggtaacgacagccagagcgacgccccctcgcaagctgccggcgctgccggatccaatggggaagaatccgccgctggaaatgaaaatgcgattctcatcggtaccattcaggatttgtccggcggcgcttccgaggccggcaccgccaacgcctggggtgttgaatacgcggtgcgcgtcatcaacgaacagggcggcatcaacggacgtccgctcgaggtgatcgcaatggactgcaaaaacgacgtgcaggagggcgtcaactgctaccgcctgctggtagatgaaaagaacgtcgccgcaatcgtcggtcccccgctctctaacccggcgctggcatgggtggatttgtctacagaggacgaaatcccgattgtgggccactttatggatgaacgctgcaccacgaatgaaaacaccggcgagccgtatccctatatgttcctggcggagccgggctgcgcgcagcaatcgtattccatcgcggcttatgccatggaaaagctgggcgtcaaaaccgtcggcaccttctataacgccgggctttcctatgcggtcatgcacgccgaaccgttcgccgactatatcacaaaaaacggcggtcaggttttggctgaggaatccttccagaccggcgacgtggattaccgcgcgcaggccgtcaagctggcgcaggccaatccggacgctgtgttcatctgcaactatgcggccgacaacgctttgtgctacgattatctgcgcgaggcaggctaccaggggatcgtgcttggaaacaatacgtttcaggcgcccttcaacacactggtaaaaacaaaggtgtatgatacttatttcctccagaatgtggatatggagaatccggacgatccctcctatgccattgtgcagaaatatatggaggaaaccggcgcccaatatccgattgccaacgcctgcttcggctacgacgccaccatggttctggccgaggcgctgaaggctgtggacgacccttatgacggccccgccgttgccgcggccctcgccgaagtaaaggacgccccaggcgcggctggacccattaccatcaatcccaagacccaccgtacacttggtatgcccatgctgatcgccgagtacgacgaaaactttacggtgaaggtgattgacacctataccctgagcgaagaatgggatcagtagaaccgtttgcgttttgcgaaatagccgtgaagcggcaggagcggtattttgccctgccgctttacagcggcgtccctgcccgggctgccggcaaaaccggccgcccaaggccgcggcgttttgttttccggcagcccctatctgtcaggaggtgtttgcttgagcctgcaattgattgtcaacggcatttcccttggcgcagtctatgcgctgatcgctgtgggcttcgccctggtgttcagcatcctgaaattctcaaattttgcccacggcggcatgatttccgccgccgcgtacatcgcttatttcttttacgcatcctttgaaacgccgccgtctctgtgggttacgcttcttttcacggcggttgtgagcctgggcgtggcgcttttgctcgacacgctgtgttaccgccgcatccgcaaaaacaacagccccaacatttactactttgtggcctcgatcacatttgctattctgatcgaacaaatcctcaccgtctttttcggcaagacctcctatggtttccccggcatgttcgaggtcgcctcggtgcgtctgctgggtgcgtcgtttgccacgatggatttggtcgtgctggcggtttcaatcgccatgctggttgtgctcatgctgttgatcaaccggacaaagatcggcctggcgatccgcgccgtcgcgatcaacccaagggcctcgcgcctgatggggatcaattccggctttattgtgctctttacattcgcgctggccggctttttggccggcgtgtcgggcacgctgctcggcatcaagtattcggtctaccccgctctcggctcctcgatgatggtcaagggctttatcgcttctgtcatcggcggcctgggcagcctttcgggcgcgatcgccgcggcgatcctgcttggagtgatcgaaatggtttcgatctatttcctgggttccagcgtgaccccggccatcctgttcggcatcatgctggtatttttgttcctgcgtccgcagggcatttcgggcaaatttgcccaggataaggtatagggggcgatgctatgaattcctactatgtcggactgctgattcaggcgtccatctccatcatcgccatcaccggcattttcgcgctcaccgggctggccggtatgttcagcctcggccaggcggcctatatggcgatcggcgcgtacatcacctttattctggcggcaaaaacagggctttccttttggatcacgagcctgggcggcatcggcgcctgcatgctggtggcctggctggccgccatgcccaccgtccgcctgcgcaaggattatttctcgctgatttcggtgggattggggcagacgatcaccgcactgctcatcaccttttccgatatcacaaacggctcgcagggcttttccaaaatcccaaaggtggagcatctgctgccgctcgcgctgcttgtgacggcgctttccattttttgtgtgcgaaacctcaaatattcccgctatgggcgcatgagcatcgcgctgaaaaacgacgagcttgcggccaaaagctttggtatcgacgtgtacaagctgaaaatcaaggtctatattttaggctctgtgatcgctgggcttgcggggattctgtacgggctgcaaaaccgcgtgctcctgccggagtcgttcggctggacagcttcctcggaacaggaaatatttctgttttttggcggcaccaacagcctgaccggcgcggtcatctccgcagcactgctcaaatgcctgcctgaattttttcgcaacgtcacgctgttcggccagagcttgcaggaataccgcaccattctttactgcatcctgattcttttaatcatcaatttccgtccgtccggcttgatgggtgagcacgaactcagctttagccggctcagggagcgcctgtccggacggcgcaaaaaaaaggagggcggcacagatggctgacatccttttaaagacagagcatctttccaaaagctttggaggcgtcaaggctgtgcaggacttcaatatggagctgcacgagggggaagtcggcggcatcattgggccgaacggcgcaggcaagactacaattttcaacctgctttcccacatctacgattacagcgaaggccgcgtaacctttctggggcgcgatatcacagagagcgatcaggtacaggtagcccgcatggggctttcgcgcaccttccagaatacgcgcctgtttgccggactttcggtgctcgacaacgtcaaggtagggcttgaccaggcgggccggtacaacctctttgaggccatgttccttttgccgcgccgccagcgcgaggagcggcgcatcgccgaggaggcgtcccgctgcctggaggttttaaatctctcccagcatagcggcgcgcggccggccaacctcccctacggcatccagaggcgcgtggagatcgcgcgcgccatcgccagccgcccccgcgtccttctgctcgacgagccggccgcagggctgaacccggaggaggttttggctctgatcgatttcatccgtctgatcaaggagcgcttccagctctccattctggtcattgaacaccggatggatctcatcatgacgctttgcgatacgatctatgtacaggatttcggcaggaccatcgccgtaggcccgcctgccaaaatccagaaggaccccgccgttttggcggcatatctgggggaggaggaagtctgatggcgcttttggaaatccgcggcctgcatgtcagctatgggcagatcgaagccattcacggtgtggatatggatgctgaggcgggaaagatcacggtcatcatcggttcgaacggagcaggcaaaagcacgctcctgggcgccatttccgggatggtcaagcgcacaggcacaatccgcttcgatgggaagaatctgcccggcgcttcccaccgcgtcgtctcagcgggcgtcatccaggtacccgaggggcgcagcatcttcgcgggcctgaccgtggaggagaacctgcggctgggcgcatacttaaactccagcgcgcggcaggtgcgggagctgatcgagcgccagtatgagctgttcccgcgccttagggagcggcacggacaggacgccgggacgctctccggcggcgagcagcagatgcttgcaatcggccgggggctgatgggcaggccgcggctgcttctgcttgacgagccgtctctgggccttgccccaatcattgtcggcgaggtgttcgacaccatccggcgtatccgggacgaggggatcaccgtcatcctggtggagcagaacgcaaaaaaatcgctgtccatctgcgactatgcctatgttctggaaaacggccgcatggtcaaatccggtccgggcaggcagatgttggacgatcccgatattgcggccgcctatctgggcgtgcgcgaagaataacaacgataaaggagacttttcacgatggaaaggcaacagcaaatcatcgacggcctgcccgtccatgtgtttgatacacgcgccgaaatgggcgcggccgcagcccggggggccgctcatatcatccgcgaagcgattgacaaaaaaggcgaagcgaacgttgtgttcgcggcggccccttcgcaggacgacctgatcgcttcgctgcttgggcaggatatcgactggcggcgggtccgggggtttcaccaggacgagtatatcgggctggaccccgcgcacagcgccggcttcggcaatttcctgcgccgtgcaatttttgaccgcgtcccctttggggagctgttttatatggcgtgcccgccggacgaagccgaagcgatgtgtgaaaaatacaccgccttgctggaggagtatcctccggatctcatttttttgggcgtgggagaaaacggccatctggcttttaatgacccggccgtggccgattttaacgaccccagacgcgtcaaagtggtttccctcgacgacgtgtgccggatgcagcaggtaaacgacggctgcttcgcttcgatcgacgaggtgccccgccaggcccttacgctcaccatgagccagattctggccatcccgcatgcgatcgccgtcgtgccgaccgcgcgcaaggcgcgggccgtcgcggacgcgctgcgcgggcctgtctgcgagcgatgccccgccagcgccctgcgcaggcatacggacgcgcggctttacctcgacgcggacagcgcgtccctgctgtaaggaggggggtatgcagctttttgacaggaccgccgacgagctagccgcgcgggatacggatctggctatcattcccatcggctctatcgagcagcacgggcctcatctgccgctgtccaccgattaccgcatcgcggcggccttcggcgaagcggtcgcggaggccgcgggcgggttttccattccgccgctgccggtcagcacatgccgggagcatatgggcaaaaagggcgctgtctggatggacccggatgttttttaccacatgctgtacagcatgctgatgagcctgaaggaacagggcctccggcgcgcggtcacgcttcaatgccacggcggcatcttcgtattgcccgccgtgatccgccaggtaaacgcgacgaacaacccggattttatggcggtcaatatcgatatttgcagcctgttcggcgttgtcgccgccgagggaatcaccgagacggacaaggagctgcacgcgggagaagtggaaacgtccctgatgctgcacatcgctccagagctggttcacatggagcgggcggtcgactttgtacccgccgtccagcgcccttatctcggctatggcagcatctttcgcgcatccccaagcggcgtgtggggcgagccgagcagggcgtccgcagacaagggcaagcgtatccttgagcggttcactgctctggctgtacaggagatggaccaggcgtttgattatatgcaggtcaaaaaaccgtttggatacagcagcttttaaggagattatagatgcaaaaagtaaaagtaatcctgatcggcgcagccttttccgccgatctgcacgccgacggctatgcgcgcgtccggcaaaaggcgcagatcgcagcgatcgtggataaggatattgcccgcgcaaaagacctcgccgcccgttatggctttacggactgcgccttttttgaagattatgagacggccgtcaaagccgtggactgcgacgttgtcgatgtctgcctgccgaacttccttcataaggacgccgcgctgtgcgcgctgcggcatggccgccatgtcatcagtgaaaagcccctggccgtcaccccgcaggaggcgcgcgagatggtaaaggccgcaaacgacgcgggccgcaacatttattacgccgaggactggctaggctgccccaccgttgtcaaggcgctggagctggtcaaaagcggcgcgatcggagaagtgaaatttatccgtgcgcgcgaatgccactgcgggtcgcacagcccgttcgcccaatccctgcggttctgcggtggcggcgcaatgattcatctgggcatccaccccgtgggcctgcttctggccctgaaggaagggcgctggaccgagctgaccgccctgacctccggcgggctggagcaaaaccttgtgcacaaatccatggagggagaggactgggccggcgcgctcgtgcgctttgccgacgggacgacggccgagcttgaagccaattatgtaaccaccggcggcatggaggacaacatcgacttttatgggacgaagggatgcctgcatctggatctgacgttctccagcgctatccgcggcttttccatccctggatttgattacaccgtggaaaaggcggagcttacaacgggatggtcccgccctgctgtggatgaaaaatacgatcttggctatgtcagcgagatcgagcatttcatagactgcatcgccgccggaaaaccggcgcgcgcgggcctgcgcggagaggacgggctgggcgccatggagcttgtcagcctgatctaccagtcggcccgcgaggggaggcatatcaaaaatccaagggaggcgtaaatggtggaggacatcagaatccctgtcaaagtcggcggcgtcacatttaaaaaccccttttatgtggcctccggtccgaccacaaagaacgtccgccagcttcagcgcattgaggaaacgggatgggcggccgccagcatcaagctgtccatcgaccctgcgccctacatcaaccgcaagccgcgttacgggctttttgatgagacaaacgccctggcctttaccgctgaaaagcgcctgacctttcaggagggcttaacgctgattgaggacgccaaaaaggtgttaaacgatttgatcctcatggccaatatcacctatgccggagaccgcggcgctgccgggtgggtcaatatggccaaacaatttgaggccgtgggcgcagatattattgaactgaatatgtgctgtccgaatatgtcgtacaatgtttcgctttcctcgggcggcgcggccagcaccagccagcagacgggggccagcctcggccgccaggccggtgtggtggcggagatcgtccgcgcgattaaaaaggagatacatatcccgctgtttgtcaagctcacgccggagggcggcgaggttgcacaggtggcggccgcgctttatgcggcgggagccgacgcggtcggttcgacgggcaaccgcctgggcctgccgcccatcgatctgaacgatcccggccgggcggtttaccatttgcaggacgagatcagtatgagctgttactgcggatcatggctgaaaccgctggcgcagcgcgacgcctatgaaatccgcaaggtctgcgggatggagccgaagatgatggcggcgggcggcatcacggattggcgctccgccgtcgagatggtcctgtgcggcggcaacctgctcggcgtctgcgcggaaacgctcatcagcggctatgatatcgtccggcccatgatccgcgggctcaaggactatatggatacgcacggctaccgctccatcgacgacttctgcggaaaggtggtgtccgccgtcaggacggcgccggagctgacgctgcatgacggttacgcccatatccgggagccgaaccttgccgggccgtgcaaggcggcctgtccgcaccatgtccccgtccaggcatacgtccaatcgattgcgcgcggcgactttcaccacgcttacgagctgattaccggcaagggcgtcctgcagggcgcctgcgcctatatctgcccgcatccgtgcgaggacgcctgcgtgcgcggacggaccgggcggcctgtcgccatcaaggcgctcaaacggttcgtgctggagcttggcagagccgaggggtggcagccgacggccgcgcaggctgtgcaaaacggacggcgcgccgctgtcatcggttctggtcccgcggggcttgcctgcgccgacgagctgagaaaagcgggctatgccgtcacaatttttgaacaggcggccgctttgggcggcggcctcaacgacgccgtcgcggcgggacagctccctgcggagaacctgaaggcgcttcttgagacgattgccggcagcggcgtcgagctgcgctgcggcgtgcaggccgacccgcagcgcctgctggaggatggatttgcgggcgtgtgcgcagccgtgggccggaccggcgtcaacccctgggcggcgctgcccggcggggagggcgtccgctctgttctcgatatggcgcgggagcagagcctttgcggcacggccgccgtgatcgggccgccccaggcggccgcggacggcgcgcgcagcgcgctgcatataggtgcggcggccgctgttgtcataccaaccgggacgatgcctgaaaagaaagccgccctgctgcgcggcgaagggattaccgtcctgaacggatacaagcccgccgcgctggaggacggggcgctgattctgtccggcccggccggcagccgcgtcagcctgccgtgcggcagcgtatggtcggcgcaaagcgaggaggtccggctcgccgcgggcgacggcgtgttcacggccggcggcgcgaacataatcgccgccgccgcgtccggatacaacgcagcggtcaggctggatcaatgggttatgggggaaaaggctgtgctgaagccgtcgccccgccccgtgcctgttgcggccgaacaggtcctaaagcgcgccggttatgtcggggacagtccggacgcgccggtgatcgcatcgaaagagcaggcgattgccgaggcgggacgctgcttaaactgcggctgcggcgaagggtgccagctctgcaaaaccatctgcacggatttcgcgccgctggtgaccggaccggatcagctggccatcgaccggacacagtgcgtcgcctgcgggatgtgctataaccgctgccccaacaaaaatattgagatgctccccataaaataagcatttgaaaggttgattcgatggaacatatcatcgcgctggaggatttaaaggcgttctgcacggccgcgctggagcatgagggcatggaaagcggcgacgcgcgccgctgcgccgaggcgcttgccgagacggacgcatatgggacgcactcccacgggacgaaaaacctgcataactatatcaaaaaattccgcgccggcgggatggatatccacgcggccctcaaggtcctgaccgacggcccggcctatgcgcttttggacgctcaaaacggcatgggtgaatgcgcctcctacagggccatggagcttgccattgaaaaggcgcgcaaatccggcgtggcgctcgtgaccgtttgccgcagcaaccacttcggcgcggccggattttacgccaatatggccgccaaagccgggatgctggggctttgcgtcagcaatgtggacccgaatatgaccgcgcccggcgcaaaggggatgctgcttggcaacaatccgctggcctatgccgctccggcaaagagcaccccctctatttttttggatatcgctatgagcaatgtggcgtcgctcaaggtggtgcaggcgcgcaaggacggccgccagattccggacagctggatcgtcgacaaggacggcctgcctacaaccgatccgagccattacccggaggagggcgccatgcagcccatggccgcccacaaggggtacgggctgtcgattctggtggaccttttgaccggcgcgcttgccaacgccgccaccagtatgagcggcgaaattgtctcctggtgcttcgagcttgacaagccaaacaatgtgagccacgcgtttttggttgtcaatcccgagatgttcggcggcgcgcaagcgtatgtgcagcaaaatgagcagatggccgcggcgctgcgcaaggcgcccaaggcccaaggctccacgcgcatttataccccaggcgaaatcgaatgggaacgttacgcgcgcgccgtaagcgaggggataaaactgccggacgatgtggcaggctcgatcgaggcgctttcggaggatgtgggcgtaaaaatcccctggaaggcgtgacgcaaagagaaccgaatgtgaatcatcgcgcatactgggactatgccgcgcaatgcggcggatagggggataaatatgaaacaaggcgttttgctggccggcgaaccgatggccttgttcatcgcacagagcgaagggcctttggaatgtgtggacggctatacggcggcaattgccggcgctgaatacaatgtggcggtcggcctgcgccggttggagcatacggccggatatctgacgaagctgggggacgacccgtttggcagacgcatcgtccgcggtatgcgggaaaacggcatcggtacggagcttacggccctctgcgccggccgccccactggatttatgctaaaatcgaaggtgcacgcaggcgatccggaaatcttttatttccgcaagggttcggctgcatcgacgctttgcgcggccgatgtggaaaagctggacctttcctgttatggcgttttgcatatgacggggatactgcccgccctgtcggacagctgccgcgcggcggcgctcgcgctggcggaccgcgcgcgggatgaagggatgtttttctcctttgatcccaacctgcgtccgcagctttggcctgacagggagacgatgacacggtttgttaacgatttggctgcgcgggcggatctgttcctgcccgggatcgctgagggccaaacgctgacaggggcgcgcacctgtgaggagatcgccgccttttatcttggcctcggcgcgaaaaccgttgtggtcaagaatgggagcgcgggcgcttacgcctgcacgccggaaaagtcgttttgggcgcaaggctttcccgtcaggcaggtggtcgatacggtcggcgccggcgacggctttgcggtgggcgtcctcagcgggcttttggaggggctgcctctgtgcgaagccgttcgccggggcaacgcggtcggggcgattcaggtcatgagtgtgggagacaacgacggcttgccgacgcgcgcgcagcttgccgcttttatggagaagggggaaccggccaatgcatgaatgtacaaaacggctttacgctgccgggatgctgccggtcgccgttatcggggacgcgcgccatgccgtgccgctgtgcgacgcgcttctggccgccggaattgatgtgattgaagtgacctttcgcacagaggcggcggcgcaggctgtcgcggccatcgcatccgaacggcccgggatgctgcccggcgcggggacgatcctcagtgtggatcaggccgaggccgctgtcagggccggcgcccggtttcttgtgacgccagggttttcacctgcggttgccgcctggtgcaaaaaccatgaaatcccgctttatcctggcgtttccacggcgaccgaggtggaacaggcgttggcgatggggttcacagacctgaagttttttccggcggagcaaagcggtggcgttggagcgcttcgcgctttgggcgggccatatcaacaggcccggtttataccgaccggaggcgtcggcctgcataacctgaatgcatacctcagcttgccgaatgtgctctgctgcggcgggagctttctggtgccggccggtctggtggaggccgggcgtttcgacgaaatcgagacgctttgccgcgcggcggtacagacgatgttcgacccgcagctatgccatgtgggtatgaactgcgccggcgcgcaggaagctgaacagcgcgcaaaggcgctggaccgtctgttcggctttgcgcccagggagctgccgggagcctggttcgccggttcagccgccgagctggtaaaaaaaccttttctgggcgcgcatgggcacctggcaattgcggtcaaccatattgaacgcgcgatggcttggtatcaggcgcatggcgttgcattccgggaggaagggcttgtcatggacggcgcgggcgtcgtggccgtttatttgcaggaggaggtcggcggctttgcaatccatctgcgccgccgcgattagcgggatgcattgcagtcgaatcatatgtgtacgccttgccataaggcggcggatgcggcaaaaggccgggactcatttgtgacgaagcagtaaaaagaaggcggacgcgatcgcgtccgccttctttttactgcccccggacaggggctgaaaagcctgtctgattatgtatttggcaagggcggcagcgcagacgcatctgtcacattgccgatacaatccgtatgcggatatgttttcaaaaattccagcgcggcttcatacgcgggcggatacagcacaatgttgacccggttgcggcgaatggacacttcattgtcagctggaagaccaaacccctgccggaccagctcgtcgaagatctcctgcctgacctgccttaaatatgtcatggagtaatccgcccgttcgtatacaatctgtatgggttcgtcgacataacgtctgtcttcgccgtcccagcccggctgatattgctccgcgaccgccctgaccggatccgaattctccagataatacacggtgacaaccttgtcaaagcggtttgccggacccacgcatccgccgtatacatcggggtccatcatcgcgtcgcagtaatcctgaaaatcgtacaccttttgattataatccattatgctgtcatccggttcggcggcgggggcctcattcggatcatctgggttcggataggtaccgtccgtattggggatctggttttccatatacggggttttgctgcccgaagccgttgacggcgcgggcggttcggactggctgggggcggcgctgacagcctgcggcggcgcggatgccgccggctggctggaaacggcgcttgagacatccggcgcaaccggttctaatacaaccggctccgacgccgcctgcgatgaagctgcgggcaattgggaggacgcgtcggcctgggacgcggcgggttctccctgcccgcagcccgccagcgcggcggacagcagggctatcagcagaagcttgcgcatcgtcatccctcctgtcatgggttgcgcggcatcgcatcgattcagcagcgtgttaacaggatagaatgcatttttacccattcctttttccttctttctttacaagcgtgtacagtcgaaaggctttgggatggcggattgctgttagcgcttgatacctcctttcccaccggcctgtttttatacaataaatttccttatattatttattataacatttttgtaattaaaagtaaatattgtgcgtatacagggcgtgcacggaaggtctgcatacttgcgcggccgcttcaaagacggtatactggtcttaagacaggcggtggattgattgaaggagcaaacaggctttgacgtggcgattgccggcgcgggcgcgtcggggcttgcggcggccgtcacggcggccggcgcgggcgcgcgtgtgctcttgatggagcggatggaccgcgtcggcaaaaagatacttgcgacaggaaacggacgctgcaacctgacaaatcttgaaatcagcgcgcggcattatcataccagggatcgggctgcgcttgcagagatgcttgcgcagatgccggctcaaaaaacgctttcgttttttgaggggcttgggctgctgtgcagtatgccggaggatggaaaaatatatccttattgctttcaggcatcgatggtgctcgattgcctgcttgccgccatacggcggcggcgcgtctgcaccgcgctgaagtttgatgtcgcggccgttgaaccgcgcggccgggactttgcagttctgtctgtggatggccgctgtgtgacagcgcgatgcgtcattctggcaggcggcggtctggccgcgccgaagctgggcggtacgggcggattgtatcaggtcgcccgagatttggggcatacggtcacgccgctgtatccatgccttgttccgatcaaatgtaaaaacgcctttgcgggcggtttgaagggcattcgcgtccgtgcgcgcggcgtattgacctgtgcggggcgcaggcttggggagcagacgggcgaatggctgttcacggattacggcctttcgggcatccccgcattgcagctctcctgcctgctgtggaagctggacgctccgtatgaaattcagatcgattttttcccagactggaaaccggaacgcctggcggcgcttctcgacgcgcggcgcggcatatgtgaaacgctggaggaatggctgctcgggactgtcccgaagcgggtcggctatgccgttatgaaatcggttggccttgcgccgctgtcgcgtccggttgccggagtggatgccacgcagaccgccgcgctcgtccgcgcgctcaagggctggacgttcgaggtgacaggtccgctctcctgggagcaggcgcagacgaccggcggcggcgtgccgctttcggaaatcgaccccgaaacctgtatgtcgcgccgccgcaggggcttgtttttaacaggcgagctgcttgatgcggcgggcaactgcggcggatataatctgcattgggcatggaataccggtattttggccggacaggctgccgtgcagatggcgcggcgcgatcgtattgactgatggccggtcaatgaaaagccgccccggtccgcaaaaatgcggaccggggcggcttttttgcaacctgtcaaagcaccgcgccatttaagacaattgattggatctcgagcttatcatcgagcaggacgacgtttgcagccttgcccggcgcaatgctgccgtggcggtcatagacgccgattgagcgcgcgggattggcggtcgcgcattttacggccgtctccagcgggatgtgcatgtcgcgcacagcggtgcgcatacagtccatgaggtttgtcgccgaaccggcgatcgtgccgctctcaagcgtggcgcggttgccgacgaccttgacagcctgtccgccgagcgaataatcgccgtcagaaagccccgtagccatcatgctgtcgctgatcaggatgatccggccgccgtttccgaacaggcggaacgcggcgcgaactgccgacggatggatatgcacgccgtcggcaatcagctcggcctcgcagtcctgtgcgtcggacgccgcgccgatgacgccgggcgcgcggtgcgaaagcggcggcatggcgttataaaggtgcgtgatatggcgcgcgcctgcggcgatagcttcggcggcaagatcatagccggccgtggtgtgcgcgatggagcagagcacctcgccgtcaagcgcacggatcatatcgagcgcgccgtccgtttcgggcgcgacggccagaaggcggatcagcccgccggaagcctgttgcaggcgccggaacatgtccgcgtcgggcgcgtggatataggcgggattctgcgcgccgcatttttcaagcgagacaaacggtccctccatattgatgccgacgagcgccgcgcagtccggcccgggcttccaggacgcggcggcgcggcagacggtttcgagcataggttcaggcagcgtcatggttgcgggacagatggccgtaacgccgtttttcgcctgataacgcgcgatggcggtgatcgcctcatgtgtgccgtcgcagaaatcataaccgacgcatccatgaaaatggatgtcgaccaagccggggatggcgtagcaaccggcagcgtcgatcgtttggcctccggcctgttctgtaaagacgccatcttcaatcaggatgtccttttggacgaacacggcgtcctcggtaaagacctgcgcgtttttgatgatcatagcggtacctccggtaaaaaagagttcgccggtgcggcgggcaggatacaaagcgtgtccgcgcccgtcaggcgcagacgcggcgccgcacccggtcagatcagcgagagggccgcctcgtcgccgaccaaagtgacatggttgtgaagctggagcacggacgcgggtacctgcggcgtgaccggaccgaaaaaggcccttttgacgatttccgccttgtcctgcccgctgacgaccagcagtatgctgtgcgcctgcatgatcgaacggattcccatggtataggcaaagcggggaacatcctcctcacgctcgaaaaagcgtttgttcgcttcgatggtgctttcggtaagcgcgacacagtgcgtctccttttcaaacgcttccccaggctcgttaaagccgatgtggccgttatggcccaggccaagcagctggagatcgatgccgccgagcgaacggatcacctcgtcgtaccgggcgcattccttagcggcgtcagactccatgccgttgggaatgttgatgctttccggcgggatattgacggcgtcgaaaaaatttttgtgcatgaaatagtagtaactctggtcgttatcccggctgagtcccttgtattcgtcgaggttgacggtgcgcacctcagaaaaatcgatgtcccctttatggtaccactcgatcagctgcttatacgcgccgatcggacttgatcctgtagccaggccaagcacacagtttggcttcataatgacctgcgccgaaatgatgtttgccgctttgcggctcatgtcgtgataatcctttgcccggtaaattctcatatctatcacctctcgcggattcagggctgcccgacaaatataacgccgcctctttttagggcggtcttgtcagcagaaccggtttgatttcattatagcagtgcgtgcggcaaaataaaagcccttcagataagcacggcgcgcgcaaagcattccggcaaatgaaagttcggcttttcgctgtcgaccggcgaaaagctggcgtaatgctcaatgtcgggcgactctgaaattttataaaaattgcagaagaactgcccgccgggcgaaaatggcgcgcgccccaattgggaagcgagcagcgcctccggcacggtcagctccacggaccagctttgcgcgccaagctgtgcgcgcggcgcgcagagcgcgtattcctccggggtgagcggacggcggtttttgcgtccgcgcccaagctttgcatacatcgcgccgttggcgttcagttcaaagttgcagtaaaagccgtcgttacgcacaggctcccccggcagatccccaaaggcgaaaaacgcttcgagcgcgctgtcgcggcagacggggtcctgcgggttgtgataaacgcgcagcggatcgcgctcctcgcagacaagctccacgcaaagccctgtgtcccgcagatatcccatgcgcccccaggccgccggccgccgccggcaggtccactggaaatggtcgatcagaaagacggggcaagccggcaattcggcgcgcgtaccgatggtgtggacctgatattccacagcaaagccctcctttgtattcgctgatgcaaggtggggacgggcggatttccgcccgtccccaccggttcggccgctgccctcagagcagcttaaagcagctttttaaattcatcggccacaaactggacctgggtgccgataatgacctgaacgctcgtcttgctcggacgcataacgcccgcggcgccggcagccttaatcttcttatcgttgacaagttcataatttttgatctcaaggcgcaggcgggtgatgcagttatcgacggaggtaatgttgtccttaccgccgaggccttcaagaatgcccgccgcaacggcggcaaaattggcgttggaaatggtaattttcttttccgcttcgatatcgtcgtcatcctcacggccgggcgttttgaggttgaatttgacgatgatgacccggaacagcaggtagtagaggacggcgaacacaaggccgatcgggataatgagccacggattgagcgccatcggagccttgaagctgaggaaccagtcgacaaagccggcgctgaagttaaagccagcgcgcactggcagcacggcgcagacagcggcagaaacgccggtcagcagcgcgtgcacgacataaagtcccggagccaggaacatgaatgagaactcaagcggctcggtaacgcctgtgaagaacgcgcagaacgcggcggagatcagaaggccgtaggcgagctttttcttctgcggcttggatgtgtggtacatagcaagcgcggcggctggcaggccgaacatcatgaccgggaagaagccgaccatatactggcccgtgacgccgagtgtgcccggcaggtcggggttggtgccccagaaacgcgcgatatcggcgatattggccacgtcgaaccagaacacggagttaagcgcgtgatgcagacccacggggatcagcagacggttgaagaacgcatagatgcctacgccgatcgggccggtgctgagaatccactcgccgaacgagacaaggcctgtgtaaacgatcggccagataaagaacaggatcaggtccacgacgattgtgacaagcgcggccacgatggccacgctgcgcttgccgctgaaaaagccgagcgcgtcgggcagcttggtgttcttgaacctattgtagcaggtggcgccgattaaaccgctgatgataccaataaactggttgttgatcttgccgaaagccgcgttcgcctccgcgccggtcaggaccgacacaacggcgggcgacagcaaaagctgcgtcatcagccaggaaacgataccggcgagcgccgatgtaccgtcgcggtcgtcggccataccgagcgcaacgccgatggcgaacaggatcgccatgttgtcgatgatcgcgccgcccgctttgaccaggaagaacgcgaacacgttcgggtcgccgacgcccgacataactgacggactgatccagtagccgatgcccatcaggataccggctgccggcagacaggcgaccggcagcatcagggatttgccgagcttctgtaaatacttcatcataacagataccctccttttgtgattgctgtctatgagaaccggtcccacagggaaccggcattccccagttgtcatgctccaaaccgcccgcagcatggacggcagggaaagatcaaagattttcctttaaaaacgcctcgagcgcggcggcggccgcgtcctcgtccgggccgtcgaaggtcatggtcagcacatcgccctttttgatcgcaagccccatcacgcccatgatgcgcttggcgtcgaccgattttgcgggcgaagcggctttgatgtcgcatttgaaggcggacgcctgcttgacaagctgtcctgccggccgggcgtggatgcccagttcgtctgtaatcgtatacttgatttcacgcatgggaaatccctccttttaaaacgtccgaagtttttataccgcgctgtcgcggatgcgtttgcgcagctccaaaatgaacggcggcgatacggaaagctcgtcgtagcccattttcaaaaacgtgtccgtcaattcggcgtccgcggccagttcgccgcagatgcccgcccagataccggctgcatgggcgttttgcgcgatgacgcgcagcatttccagcacagccggatgatgcggatcataaaatttgtcaagctgctcgttctgacggtcgattgcaagcgtatactgagtcaggtcgttggtgccgacgctgaaaaaatcgacaagctttgcaagctcggcgctgaccatgacggcggcaggcgtttcgatcatgacgccgcgttcaatctcgtcgaccacgattccccgcgcggccagctcggcgcgcgcttcggcggccagcgccagggcacgtttcgtctcgtcggctgagataatcatcgggaacatgactgctaccttgccgtaagcggacgcgcggtagatcgcgcgaagctgtgtcttgaacagctccggccgctccaggcagatacggatcgccctaaagccgagcgcggggttttcctcacgcgccaggccaaagtaatcggccttcttatccgcgccgatgtcgagcgtgcggatgatgacaggcttgccgcccatctgctcggcagccttgcggtatgcctcgaactgttcgtcctcgctcggatagtcgtcgcggcccagataaagaaactcgctgcggaacagccccacgccctcggcgtcattaaagagcacggcagggacatcctcaggtccgccaatgttcgcgtaaaggcgcacctgcctgccagactttgttacagagggcagtccgcgcaccgcgtcgagcgcgcgccgctgctcggtgtccgcgcgccgtttttcacgcaggcgcgccacggtcgcctcgtccggatcgagaaaatactcccctgtgaagccgtctaccgcaatcatgcgcccatgcagcttctccccggacggcacgtcagcctgcacaagcgaggggatgttcataatgcgggcgagaatcgccgtatgtgagttggccgagccttgccgcgtgacaaacgcaaggatgttgtttttatcgagcgcaaccgtttcgctcggcgtcaaatcgtccgccacaagcaccatcggctcggtgagcgccggcacgccctcgcggccgcacaggatgtcggacaggcgctgcgatacgtcgcgcacgtcggccgcgcgcgccttcatgtacgggtcgtcgagcgaggcgaaaaactctgaaaactgccggccggcggccgcgacggctgcgtcggcgcccgacccgccgcggataccctcctcgacggcgtcgttgtagtcgccgtcgtcgagcatcatcatctgtacgtcgatgatcatcgcctcgtcctcaccgatttcgcgccgcgtcttttcatacagcgcgcgaagctgtgaagctgccgtctcctttgcggtgtgaaagcgtgacagctccgtcgcctcgtcaagcaccgggacgtggcgcgctggggcgctcacgcgttcaaacgcgtagaccggtccgattgcgacgccggaaaagacgcttcttccatggcctttgaacaagataaatccctccctccatccgcagatgggttgccgttcattatttgcgcaggcggatcagctcctccaattcgccggcgtgcttgcctgtaaaggtttcaatttgggaaaagtcggcggagttgcagacgacgacgggcgtgataacctgatagcctgccccgctgattccatccatgtcgaattcaatcagcagatcgcccgtcttgacgcggtcgccggtcttgacatgcgccgtgtaaaactgccccttgaggctcacagtatcaagtccgacgtgtacaagcacctcggcgccgtcatccgaaacgatgctgacagcatggccggtgtcaaacatcagggaaatctggccgctcaccggtgcaacgacgcggccgcgctccggcttgatcgccacccccttgccgagaatctcctcgccgaaggtgggatcgctgacctgcgtgaccggaacgacctccccttcaacaggcgcgagaatcatgacggctgcatcctttgcgccgaacatatttttaagctttccaaacatattgtcacaaccttctcgtttgcacggcggatgccgcgcgtctttgtcgcttttatctagcgcgcagtgcagtatagtctgcgccgttttcctcaaaagatactggacgctgaaaatggacaagccatataccgcaaccaatatcatagcacagcagcacgccgaattgtgctgaaaaagcgcgttacgcgtccggcgctgtcacacgccggatatggatcgccaaacaggccgcctccagatcgccgatcaaaaatgaatgcgtgtcgcccagataagcgccgacgcggtgcgcgcaggcggtttcgccgggatagagcgcggcgatggcgtcatagagcgcccggtcgcccgccggcgggcgatcctggcgcagcgcgcgctgcgccaggaatttcagatgtgtgacaaaccggtcaaaatcaacggaagtctcgtccagcgggcgtctgtgccaatcgcgcacgatccggagcatctggtcaatcaggtgcgtgatgtcgacagcttctccaagcgatatgtcgtattccgcgttgacgatgtgcatggcgatcgacgcggcctcgtcgtccggaaaacggacgccaagctccttggcgatcaggtcaagcgcatactggccgatggaatattcctgtggataaaaccgcctcatttccgccagcagggcgttgtgaaacatcatattttgcctgaaccgcaggaccgaaaagctgatgtggtcggtcagcgtaatgtagatgctgtgattgagccgcttgcccaagatcttgcgggcataggcgatgattcggtttgtgacctcgatatgttcaagcggcatggaggaaaaaagctgcttgagacggtcggtttcattttgcgtgtccatgtgaaagattttctctatcgcttccggcgggatgctgtcgccctcacggcatttaaagccgatgccgcgccccataacgacaatctccttgccgttttcatcgcgcgcgctgacaatattattgttgatcgcctttaaaattttcatccataaataccccgcaaaatacaaaaaaaccaaatttcgcacagtccctctcagccatgcaaaatttggttttgcctgcattaccagtaacaacccaaatggtttatgaactttctgttaactattataaacgggcaggcaattaatgtcaaccgaaaaacccaaggaatttaattgatttttgtacaattttgtcagcaatttcttgtgcgtcttgccgaaacaaacgttattaagtttcaaagtggggcatagcgcacgccataccccactttggttttaaacttatccatgcgctttcatacgcgcatatttttccctggttgcaattccgccgcggatgtgacgttcggatttattgtggtcgagcacttgcttaacctgtgcgtaaacgagcggattaatgcgctttaaacgctctgtgacgtctttatgtacggtcgactttgatatatgaaattccttcgcggtagcacggacggttgtattgtgttcaatgatgtagtgcgcgaacgtgatggcacgttcctccggcagacctttcaagacggaaacctcccctgcaattactgtctatggcagtatatgcagggccggcggcggtcagaacgccatttccagaggcggcgcaggaaaaggatacgcaaaacgatgcaaaataaaaatacccccttccatacgcggcgcggcaatgcctggagggaatggtggatttctatatacttgtatgctatatttattttcacaatcaaaatgattcattaaacggaaaggtaaaagaaaaatgaaacttattgaagtgaaagagagaacgcccttgctgatagaacagcttacaaaagtatgggaaagttctgtaaaggcgacgcatctgtttttatcgggctgtgaaatagagaaaataaaaaaatttgttccgcaggcgctcaagggaattgactgcctgattgttgcagaaagcgaaagcaaaggaccggttgccttcatgggagtggaggaacaaactttggaaatgctgtttatcgcttccgaagcaaggggaaagggcttgggaaagaagcttattcgatatggaatcgaaaaccattccgtccatcgattggctgttaatgagcaaaatccccttgcgatcggtttttatgaacacatgggatttcgagtttataagagaacggaccatgacgaacagggaaatccgtatccgcttttatatatgaaactcgatggagaaagttcccatagataaacaggcgtgattcaggatacaggcgcctttcaacagctatttaatttaaagggaggcgcccggcccgggtaagattatatcggggggttacaactcgccgtcgggaacatactcgacgatttcctcaatctgacaattaaaaattttgcacagcttgtcaagcgtatgtgttgatacgggcaagtttgcctgtagacgctgaacggttgcgtgactcatgccgtatatcacccgcagggtgtaggtggtcgctttttttctggccatagtctcccacaaaggacgatatcgtatcacggtcctgcctcctgtgctttaaattgtgcaggtaagaagcacggccggcacagggctgctgcctgaccatgtcatgcgtggctcacaaggcttcatccggcatatattccgccacttcatccagccggcaatcaagaattttgcacaggcggtcgagcgtgtatgttgagacgggcagatttttttgcagccgttggaccgttgaatggctgatgctgtaaatttctctcaatgtgtaagttgtcgcctttttttccgccatagttttccataacggtccgtatgaaatcacgccgcccaacccctttacatagtccattatggctgttataatggccataatgtatggctgttatttggccatacagagagaaagccagcgcctgtatcagataaaatagcgtttgttagttatagggtggacgatgcgattttgctttttcgatggaaacagacaaataattttaaaaaattccgttatttgatcttctgtacaaatgtttgctgttgttttataatggtatcaagcgccataggcgcattgagaggagcggctttagatgagacatgtggtttcgctttacaatggcattgaaatgccgttggtggggcttggtgtctttaagaccaacgaccagaaagagatggacaacgcagtgcggtatgcgctcgaagctgggtatcgaagttttgatacagcgcagatgtatcaaaatgaacatattctgggcgagtcgctgcgtcgcctggatatcgtgcgcagcgatgtctttctgacaagcaaactggacaaccccaaccaaggatacgacaaggccctgctgtcattcgaggaaagcttgagaaaattaaagacagactatcttgatcttttcctgatccactggccgggtcagaaacgctcgcgcttgattgaatcctggcgcgcgctcgagcggctgcataaggagggacgcatccgcgcgatcggcgtttccaattgtatgaagcggcacctgcaatggatggccgaggactgcgacgtgatgccggcagttaaccagattgaacgccatccgctgctcaaccagaacgggctggcacagtggtgcacacagcgcggcattcaggttgaggcatggggtccgcttgtgcgtggcagcttcgatttcccgcagatccgggagatggccgcgcgttatggcaaaacgcccgcgcagatcatcctgcggtggaatgtgcagagcggctatgcagtgatccctaaatcggtacaccgcgaccgcatctttgaaaacatcgatctgtttgattttgcgctcgacgaggcggatatgcgcgccatcgacgcgatggacacaggcgggcggacaagctttgaccccgagacgtttgatttttgaagcattggcggatgcaacaaaaaggcgcccctggaacacaggttccaggggcgcctttttatagacatgcgcatttaaaagatcagacgcgccgcgtgatagataaggaatgcggccgcccaggcgatcaggcattgccccatgaccatgacggctgcgtaacgcccgccaagctcgcggcgcacagccgcaatggcagcgacacacggcgtataaagaagcgtgaacgttaagaacgcgaccgcggcggcgggcgtgaaaatctgcgcgagcgccgccggcagcgtcgcggtgttcgtgccggtgagcacagccagagtgctgacgacggcctccttggcggaaaagccggtgatcagggcggtcgacgcgcgccaatcggaaaaaccaagcggcgtgaacaccggcgcgatcaaccggccgattccggcgagcatactcgcctccccgcctgcggcaacgacattcaggcgtgtgtcaaacgtctgcaagaaccagatgacgattgtcgccagaaaaatgaccgtaaacgcgcgtgtgagaaaatccttcgctttatcccataagagcagcgcgacgtttttcggcccgggcagacggtagttgggcagctccatgacaaacggcacaggcttaccgtggaaggccgtatttttcagcacaagcccgcacagaacgcccacggccatgccgcccgcgtacaggcagatcatcacaagcgccggatgctccggaaagaaagcggcggtgaacatggcatagatcggcagcttggcgctgcacgacataaacggcgtaagcaaaaccgtcatcttgtggtcgcgttcagaggaaagcgtgcgcgttgccataatggccggcaccgaacagccgaagccgatcagcatcggcacgaacgaacggcccgacaaaccgattttacgcagcagcttgtccatgacaaaggcgacgcgcgccatgtagccgctgtcctcaaggatcgagagaaagaaaaacagaacgacgatgatcggcagaaaggaaagcacgctgccgacgcctgcgaatatgccgtcgatcacgagcgaatggatgaccggattgagtccgtagcgcgtcagagcgtccgacgctgcggccgtgagcgcgtcaatccccattgacaacaagtccgagagagccgtgccgatgacgccgaacgtcagccagaagatcacaagcatgattatgagaaaaatcgggatggcaagatatttgtgcgtcagcacattatccatgcgcaggctgcgcagatgctcgcggctttccgtaggcttaacgaccgtttgggcgcacagactgtcgatgaagctgtaacgcatatcggcgagcgccgcctcgcggtcggtgccaagctccgtttccatttccgtgacgctgtgctcgaccatatcctgttcattctgtgaaagctccagccgctcaagcatcggcaggtcgccttcaacaagctttgtcgcggcgaaacgcggcggcaccccgattcgctccgcatggtcctcgaccaggtgcgcgatcgcgtggattgcgcggtgcactgcgccggaacagaagtcgaggcgtgccgggcggcggcggtcgcgcgccgtggcgatggccgtttcgatcagctcgtcgatcccttcgtttttgacggcggagatcggcacgaccggcacgcccagctcctccgacaggcgtctgagcttgatggtgccgccgttggcgcggaactcatccatcatattaagcgccacgaccatgggaatattcagctcgataagctgcatgctcagatagaaattgcgctcgatatttgtagcgtccacgatattgatgatgccgtccgggtgctggttgagcagaaaatcccgcgtgacgatttcttcgctcgtatagggggagagcgaatagatgcccggcaggtcgacgaccgttacgccgcgccgcccgcggatctcgccgtccttgcgctccaccgtcacgcccgggaagttgccgacatgctggttggagccggtcaactggttaaagagcgtcgtcttgccgcagttctggttgcccgccaatgcgaatatcatttggaggtgtcctcctcgatttcgatttcgcgcgcatcctccaggcgcaacgtcaattcatagccgcgcagatgcagctcaatcggatcgcccatcggcgcgaccttgcgcaccataacgcgcgttttcggcgtcagacccatatcgagcagccgccgccgcagcgcgccggccccgcccaccgtcaggatggtgccgctgtgcccaatgggcagtttgtcaagcgtcaaaaaaatcgcccccgtctatctgcgaatcttgtcttaaccgattcattttcaaataaaaattccggtttcaatgatacccttgcacgcgtaatttgtcaagaaaacgcggcggcacgccggaaatgaaatgaacgttgatttcacggacaaaataaagtatgatggagaaagccaaacggtgcggccggtccgcccgggaaaggaagtaactatggcattttacagattggtaactgatagctgctgcgagctggttcccgcactgaaaacgcgtctgcatgccgcacaggcgccgctgaccatgctgcttgacggcgtcagctacacggacgatgagacccttgaccgcgaccgctttcttgctgcgatgaaggcgagccgcagcgcgccgaaatcggcctgcccatcgccggactgctatgcgcggctgttttccggtgagggcgatgtgtttgccgtcaccatctcctcaaaactcagcggttcttataacagcgcccaaatcggccgcacactcgcgcttgccgcgcgccccaatcagaaaatccatgtatttgattcctgttcggcgtcggccggcgagctggcggtttccctgcgcattgcggagtatgtgcaggcggggcttggctttgacgagatcgtttcaaaaacagaagcgttcatccgcgggatgcgcacattctttatagcggaaagccttgacacgctgatcaaatccgggcgtatggggcgtataaccggttacgtcgccttggcgatgtctctgcggccgattatgacagccgatcatggagaaatcaagctgtatgaaaaggcgcgcggctctgtacgcgcttttacgcgtttggttgatatcatcggggaatgcagcgccgacctgtcaaagcgcacgctggtcgtttcccactgccataacgagcgccaggctgccttcgtcgccgccgaggcaaggcggcgttacccatttcgagacgtggtcgtcgtgcccacaggcggactcagctccatgtatgtcaacagcggcggcgtgatcatcgccttttagagggccgcgccggcgctgccggaacataaaaagctgggccggacacagatgtgtccggcccagcttttgcgtatttaaggacgctttcgtgtcctgcgtttgaatgtaaaatccaattcacgcacgacgcctttcgcatcatagatgcgcgctccatcgcccggccggctgacgccaagctcccgataaagcgcgcgctccagctcatgcgcgctccgtcccgtttgaacggccgcgtcctgcctttcttcagcgtccgtcccgctctgcggacgatcgccgccacattctggagccgtatcggtcccttcctgcgtgcgctcgctgtcctgctccctgccggattcctgcgcaccggtaagctccccgcttttttcggcggtaccggcgcgcttttcgtctatgatctcctgttcactcggcagacgttcataatcgccgtttttgataaagatcttctgttcggtctgaataccgatcatgcggcgggcaatccgttcaagctggccctttttttcagctaccgacagattggggttgctggagattgtgcgtgccgcgctcaaatagccctgcatcttgttgatgtagagctgatcggcctcctccctggtcttgcagttggcgagctgctgcttatactgcgcgcgctcgcgcttgatctgcatggcctcctcgtagagcgtgggggcgttgatgcgcagatactccaactcctcaggcgtcaattccccgccggaatcgagcttgctttggatcgatgcgatagcgttgcttttacgcgtgtcgctcgcttgtttgcgcagcatggcggcctgagggtcctcgccttccctgggcattgtggggtcggccttgcgctgctgccacttcatactgagtcccatcatccgaatggactggaacacggatccgatcaccggcaacgccattgaaaatcctccttcaacgctgtctgataaatgcttctgttatatatattcgtcagcgatggcaattcacaaagcgtttggtgaaaaacttgtgaaggaaatttccagcgtggccgccggatatgggatccggtcagccagcttttgcgcggcggcgcgcccgcagccaggctgtcaggcggccgtcctcacggatgaggagcacggaaaacaggatcacggctgcgccggccattttctgtgcattcatggattcatgcagtacaagatggctcatcatcagcccgacaatcggattgatatatgcgtaagtggaaacgaccgatgtgggccaccgtttgagcaggtacatgtaggagccaagcccaatgatggaatcggccacgcccatataaacagccggcagcacgccgcccagattcagcgtggaggggcgcagggttccggtgaacaaggcggtcagcaggaaagccgcggccggtacggctgactggacaaaaatctggaggatgaagggcgcttccaccgtgcggtttttcaggtagatggtgcccacgctccatacacagaccgaagcaagcagcagagtgatgccgccgatatccgcgccgccgccgagcagcccgctggccgacgcgatcacgacgccggcaaagccgcccgccataccgatgacaccgggcggtccaacgtcaaaatgacgctgggcgagcgaatcgacaaggacaagccccacaggaatcagacagagcacaatggtcgaaatgctcgcatcgacgcgtacagcggcgaacagaaccagcagcgtgttgagaaagtacatcagaaagctgccggtgccgagcgttttccagtcgcggcgggtgatacgcagaggaacaccgcgcgcagccgccgccagagcgatcagaagcgttgtgacggtgaagcggacggcgcccaccatcagcggatgcatggaggtagacccaagcttattcgccacggtcgaagtcccccagaaaaaacagatattaaaataagcgatccatggcaggacagcctgaaaaagcattttctgtttcaaaacggttcctcccggacgaaggatggcgcggcggccatgcgccgccgcgcagaaatccccgggacccggagggatcccggggactgggcgtcgggccggtcgccggcctaagcctttttgccgacctcgatcatcttgtcgcagctttcggtgacggcgttcatgaccgtattgcggaagcccccgcgctcgagcgcatgcacgccgacaatcgtgctgcccgctggcgaacagacgctgtcctttaactcggccgggtgcttgccggtctggagcaccatctcagccgagccggccagcgcctgcgcggcaaggcggatggccatgtcgcgcggcaggcccttttcaacgccgccgtccgccatcgcctcgatgaacagatacgcaaacgcggggctgcatccgcttacgcttgtcagcgggtcgatcaggttttccggcagcaggtacgacatgccgaccaggttaaacagctcgacgccaagcgcgctgtccgcctctgaggcgtgcgcgccggcggcgatgccggcgatgccgcgccgcacaagcatcggcgtattcggcatgacgcgaaggacagggttttgcgggaaaaattcctccagaaaaccgagcgtgatgccgcccatgatggaaataacgagctgtgcaggcgaaaacgcgccgctgaccgccgtgagcatcgggcgggcatactggggtttgattgcgaacacgacgatatcgctgcgttcgatcaccacgcgcgcgccgctgttcgcgccgtcgttgacggcagtgaaaacgccgtattttttccccagtgtatcgaggcgttcagcgctgacatcggtgacggaaacctgctcaggcttgaccaggccgcttgccaggacgccgctgaaaatcgcttcgcccatctggccgccgccgataaatccgattcttttttgttcaatcatttgacgttcctcccatgccgccggattgcggcggccgtcgattcatcatatatattcttacatcggcaggcgcattaactcctgcggcgctggcgtgagaagctcgcagcccgtttcggtgacgacaaagttctgttcaatgccgaatacgccgatttcagcgtcaaaaagctcaggctcaagcgccatgaccatgcccggctccaggatgacgtcgcagtccatcgacagcgtcggcagctcatgcacatcgaggcccacgccgtggcccatccagcccttgcagcggttgtaggggtccataccctttgaggagaaaaagccgtcgacaatgcggcagacctcgctggccgggatgcccgccttgataacggaaaggccaaggttgttgccctcgacagcgatatcatacatcatctgctggcgatcggtcggcttgcctgaaactgcctggcggatgatgtcggagtaatagcccttgtagcacgggccgccgtcgacgagcatcatttcgccgggttctttgccgatcacgcggctcgaaggcgggcagttgccctgggagtaccgctcgcgcccgcagcggatgccaagcggcaggatgttttccgccccctgcagaaagctttcggcgcacatgatgcggtaaagctcctcctcggtcgttttgccgcagacgatgctctcaaagcctttcttgtaggatgcgacgttgatccggcagacctcgcgcatgacttcgatctcgcgcggcgatttgacgcggcggatctcccataaaagctgtgcggcgtcggcgatctcggcgtccgggatcagcgagaacagagctttctgatcggcatatgacatgctgacgcggaaacccgtgccgatctccatgccgatgcgcccgccgctgaccttgaatttttcaagcgcgtaggcgattgccttggggaacgtgtccgggaaaccaggctcctttgtgcgcgtataggcgagcaggcggtccggctcgagacacgacgtcaccttgacggtcggctggttgcttgtggagctgacaatcgtcatatcgccgttggccgtcacgaccaacaggcccggcaccgcgatcttgctgtcccagacgatcgactgcaagcccgaaaaataacgcgtattctccttggaggagagcagcacggcgtcaaatccgtatttctgcataccggcgatcagcttggcgattctggcttcatattcatcaactgggaattccagcatcatggaggtttgcatggatgtcttcctttctcagaccgaatgacggtcaggcttatttttgatagggcgcttggctctgatagaggtggcagcttacaatatggccgccgagatcggctggctgcggacgctgctggcggcagacgtccatcacctttggacagcgcgtgcagaaggggcagccgggcggcgggttcaccgggctgggaacgtcgccgccgagcggctcgcgatccttgtgaagctccgggtcggggatagggacggcgtccatgagcgcacgcgtgtacggatgcagcggatttttaaacagctcctccgtgccggctgtctccacgatatgcccgaggtacatcacaaggatgcggttacacacatgctcgacaacgctcaggttgtgggaaataaagatataggtcaggccgaactgcgcttgaagctgctgcatcaggttgagaatctgcgcctgaatggacacgtcgagcgcggaaacaggctcgtcgcagacgagcagcttcgggttgagcgcgagcgcgcgcgcaacgccgacgcgctggcgctggccgcccgaaaattcatgcggataacggtcgtaaacatcctcgcgcaggccgacggcgcgcatcagctcaacgacgcgggcgcggcgctcggccggcgcgcccgccttgtgaacgacgagcggttcggcgatggagcgcccgaccgtgaagcgcgggtcaaggctggaatacgggtcctggaacacaatctgtatttcccggctgatgcgcgcctgcgcctggggcggacaggaaaagaggtccatcccgtcgtacgtcacgctgccggcggtcgggcggttgaggcggacaatcgttttgccggtcgtcgatttgccgcagcccgattcgcccacaatgccgagcgtctctccctcatacacgtcgaaggagatgccgtcaacagcacgcacaagctttttctgggaaaatatcccgcgagagcggaccttgattggataatacaccttcaggtcccttactgcaagcagcggttttttctcatcagtcaaggcgtttgcctccttcctcgcacaaaaagcaccgcgcccggcggccgtccggcatttcatacagcggcgggcgctccgtgcggcagcggtcggcgctgtgggcgcagcgcggcgagaaccggcagcccgccggataatccttggggcttgggaccgtgccgggaatgttgtaaagcgcgtcgacgcgccgccccatgacgggcacgctgcgcaaaagtccctctgtatacgggtgcaggggatttttgaacagctcgtgcacgccgccgtattcgacggcctcgccggcgtacatgaccataacatcgttggcgatctccgccacaacgccaaggtcgtgcgtgatcaggataaccgacgcgcccatacggtccttgagctgggcgatcagacgcagaatctgcgcctggatcgtcacgtcgagcgcagtggtcggttcgtcggcgatcaggattttcgggttgcacgcaagcgccatcgcgatcatgacgcgctggcgcataccgccggagagctggtgcggatattcgtcgacgatgcgctccggcgtcgggatgcccacgagcgtgagcatctcaacggcgcgtgcgcgcgcctgctttttcgtcatgccctggtgcagcgtcaggctttccataatctgctggccgacggtgaacaccgggtttaaggaggtcatcggctcctggaagatcattgagatgtcgtttccgcggattttgcgcatgtcgcgctcactgagctttaacaggtctttgccgttataaaggatttccccggcgatgatgcgtccgggcggcgactgaacgatgcgcaggatcgacagtgacgtgacgctttttccgcagccggattcgccgacgattgcaagcaccttgccctgttcgagcgtgaagtcaagcccgtcgacaccgggcagtacgccctcctcggtataaaaatatgttttcaggcccttgacctctaagataggttctgccatggccggaccctcctcaactgtttttcaatttcgggtcgagcgcgtcgcgcaggccgtcgcccacgaggctgaagctcaaaaccacaagggtgatcatgacgccgggaatcagagcggcaaacggcgcgctgcggatgacgtcgcgggctgtggagagcatggcgccccactcgggattgggaggctggacgccaagccccagaaacgacagcgacgaagcggtcaggatcgctgtgccaagatccatcgtggtgttgacgataatctgcgacatcgcgttcgggatgatgtgcgtagcgatgatgcgcgcgtgcgacgcgccgaacacacggcaggcctggcagtattcgctgttgcggatcgttatgacgacgccgcgcacaaggcgcgcgctgatcggaacggaataaaacgcgatcgcgatgatgacgttctgcattccgctgccgagcaccgctacgaccacgatggctaaaagcagccccggaaaggcgagcaggatgtcgatggcgcgcgagatgaccgtatcgatccacttgccgaaataaccggccatcgcgccgagcaggatgccgaagaaagcgccgatgagcacaccgcagagcgacacgccaagcgacacgcgcgcgccgtagacaatgcgcgcgaacacatcgcggccgaggttgtcggtgccgaagatgtgcgcggcgctcggcgcctggtagcagatgtccgggttgatggcgttgggatcggtcctgcacagcagtggtccgaacagggccgtcaggaaaaagatgatcagaacaatgccgccgatgacggaggcgggccgtttgataaagcgccggaacaccgggtttttaaacacgcgccttccctcctaatcgtatttgatgcgcggatcgatcagggcatagatcagatcgaccgccaggtttacaaggacgaatgtggtggccaatacaagcaccgtgccctgcacgacgggatagtcgcgcttgagcacgccgtcgaccatgaaacgcccgatgcccggcacggagaacacagcctcgacaagcatggaaccggccagcaggccgccgaagcgcaggcccaccaccgtgacaaccgggatcagcgcgtttttaaaggcgtggcgcatgacgatgacagcctgcgaaatgccgcgcgaacgcgaggtgcggatataatcctgccgcagcacctccagcatggacgagcgtgtcgtgcgcgcgatcagaccgaccgactgcatcccaagcgtgatgatcggcagcacgtaatgaagcggcgtgcgcagccccatgctgggcagccagcccaaatgtatggagaacagaagcatcatgacaagcgcgaggaaaaacgacggcgtcgacacggagagcagcgaaaaaaccatgatgacgttgtcggtcagcttgttctgtttgacggccgacagaacgccgaatgttatgccgaccacggcggcaaagacggtcgcgccgagcgccagcttcagcgtggcggggtaacgctgcgcgatctcgtcgatgaccggacggcgcgtggtgatcgatttgccgaggtcgccctgcagcgccttgacgagaaaatcgccgtactgtgtcaaaagcggcttgtccagcccaagctccgcgcgctgcgccgcaatcgcctccttggaggcgttgacgccgagcatgttcgccaccgggtcgccgggcacaaggcgaatcatcataaagcagataaaggaaatgatcagcaggactgggatgacctgcaaaattcgtttgatggtgtaaccaagcacgggacgctccctcttttccggttaaagtgacccgacgatctcgtaatcgagtccgcgtgttttcgcgtcgacaagcgcggccaaaaagccgaatgcgctccaaaagctcttgatggtcagaacttgcttgagcacggcgttgctcttatccgtttcgccgttgacatagtaataattcgacaggccatacccttgcgtggcgatctccagatccggaaactcggcgccctcgaactgcatcagctcctccggcttgatcagtcccttgtacatcaggatacggcgcttgtaggagaggttttcgccgggatcggtgttttcgtcgacacgcttgagcagcgcctcggcaagccgctcgtcgcccaggcgtttggcggtcatccagtaccagtcgacaaccgcgacgactttgtcggaggtgtcgctcttttccaggcaggtgcggtacgccccggccgcgcgcttatagtcgccgagcaggtaataggaaagccccaggtgataccaggtgtcccagttggtgtcgtccagacgcgccgacagcgcaaagtccgcagccgcctcctcaaaacagcggatggacaggtagcggtggccgcggtggcggtaggtaagagcgtgaaacgggttgaagctgagtcccttggaatacgattccacggcctccttaaaaagcatctgcttggacagcgcaatgccgcggcgcatccataattcacagttggaaggatcggcttccagctcgcggtcgattgcgcgcacctcgtcggaaacaggcagcttggagcggttgaactgaatctcggtttccttggttgcggttgtatcagtaacgtcgatatgcatatatgtagacatggctttgactccttttctgatatcaaatgtatgggaaagccccgtggggacctttcattttttggaaggcagataataaagtatgggcaggggaccgtcccctgcccatacgaaaaacgtccgccttttggttatttgacagtcgcgttgtcaaacaggacacagccgagcgcgtcgacgcgcaggccatcgattttgtcgctgttgtaggcgaatacattgagctgatcgtaaagccagatgccggcggggtcgtcgagataaagaatctgaccggccttggcgtaaatctccttgcgcttttcaggatcggtttccgtcatgccctgttcgatatattcgtcgacctcggcattggaatagaagccgtagttgcggtcgtttttgccgtcgggcgtggtggtgtaaaggccgcggtagccgccgtcggcatctgccatcgaggtgcccgcgcccatgataaagagcggcgcgtcaaattcctcggctgtcataccgctgatcatcggacggaacacgctccattcgagcacttcgatcgtcgcgttgacgccgatttccgcaagctgtgcggcgatcatctccgcaagctcggagcctttgtcatactgggtggtggtgacaatttttgtatcaaagccgttcggataaccggcctcggccagcagggcctttgccttttcaagatcctgtttgatcggaccgtaatcgtggctgccgaacacggcgggcgccaacggcccggtcgtctcctcggagacgtcggcaaagagcgccttgcggatggcgtcgcggtcgacagcgtagttcagagcctggcgcaccttggtgttggacatgatttcatcgttgcagccgaagcggaacagacgctggccgacgccgggctgcttgagcacggtaatgccctcgagtgtttcaaggcgcgcgacctcctcggacgggaccttgtggatcatgtcgacctcgccgttttcaagcgcaatgatacgcgaggacgactccgggatgaccagataatggatggcgccgacctgagccttattgccgaaataatcggggttggcttcgatgacgacctcctcgtccttggcccagctcaccaccttgtagggtcctgtgccgttgactgtttcggccgttgttcccagatcgcggccgtactgctcgataaaatcagaatccatgatcgctgtgttatagttgcacagcagactgagcatcggtccgtaaggctccttggtcttgatgacgacggtggcgtcgtcggcggcggtcacgctctcaatcggcgagatcatcgaggtcgtgatatagccggaatcctccggcagcgcgcggttgaaggaagcctcgacatccttggcggtgagcgtcttgccgttgtggaatttaacgtctgtgcgcagatggaacgtccagctaaggttgtcctcgctgacctcatagctttcagccagacttgggacgggggtattgttttcgtcaaagacatacagcgtgttgtataccattttgacgacttcctcgctgtaactgtcgttctgcgtctgcgggtcgagcgaggagacatcggcggggacgccgaataaaatttcgccgcccgctccggacgagacgcccccgcctgctccggacgccgcgtccccagagccgcctgaacctccgcaggccgccagagacaaggccatcatggcggctgtcatgaatgcaatcaatttcctcatggtgcaaaatcctttccataaacgtaagaggcccttcgtccgcacatacgggatttaaaggcataaagcggccgaggacatctgtatgcgcctgtaaactctttattaatataccatgaaaaagcatgtctgaaaagaaacttttattctggttataaaactatgagttgtgaaagtgcgtatgatctgttatactattataatataaatgcatggaaaggaacccgagagtcgaaccatatgaactttcaggatatcacatattttttgacattatgtggagaaaaaaccttttccgctgccgcggacaagctgttcattacacagcaggggctgagcaaggccattcgccgcatggaaaatgaaattggcgctccgctgtttgaacgcggccgcaaaacgctggcgcttacaccaagcggagaggtgtttgtacgctacgcgcaggagatgcagggcatttacgcccgtatgcgggatcatatggagcgtctgcgcgatgaacggcacaacattcggcttggtatgacgatgggcgtgccgctcgcgatccaggcggttgagcttgagcagctccggcgcgctttgcgcccgtgtgagctggagctgacagagacgaccgatttttcctgcgaggagcaggtcgcctccggtgcaatcgattttggcgtcacacttgagccggtcgatcaaaagcggtttgcctgtgtgccgctgctgtcccgtccgatgtacgctgtggcgccgcagggcgatccgctcgcaaggcagcagcgcgtcgatgtggcgctgctgcgtggcagaagatttgttctggcggatcgccagtttaaatgctatggccagtttcatgaattgtgccggcgatacggttttacgcccgacgtcgcagaaacgacaatggaaacgcttgtgatctaccggcgctgcctggaaaatggatggatcggcgtcagcgccgacctgccgcgtgtaatgaacgactgcccgggggttgtgttcgtaccgtttgacacagttgaatttgcctggaatatcacgctgatttctgcggccgaccgccagctgacgccgtttgaacaaagcgtgcagaaggatattgcggctctgtttcgctgactgggagggaaagcgcgtggctaaaaatccgaatcaaaagctgaagcttttgtacctgatgaaaattttgctggagaacaccgacgaagaccacggcatgaccatgccggagctgatcgcttcgcttgcagggtttggcatatctgccgagcgcaaaagcctgtatgacgatatcgaggcgctgcggctctatgggcttgatatagagcgcacgggccggcgttattttgtcgctgacaggatttttgagctgccggagctgaagctgcttgtcgacgctgtgcagtcatcgcgctttattactcacaagaaatcgactgagctgatcaaaaaggtggaaagccttgcaagccagcatcaggcgcggcttctacagcgtcaggtctatgtttcaaaccgtgtcaaggcgatgaatgaaagcatttattacaacatcgacaagctgcataccgctatctcgcaggctgtacgtattacattccggtactttgagtggacgattgatttcagcgccggcgcgccgtttcaaaagcagtaccgccatggcggcgcgcaatatctcgtcagcccctgggcgctgacctgggatgatgaaaactattatctcgtcgcgtatgattccgaagcgggtatgattaagcattatcgggtcgacaagatggacggcattgcgctgactgatctgtcgcgtgacggacaggcacagtttgaaaggtttgatatggctgtatacgcgcgaaaaatcttcggtatgttcggcggcgaggaggagacggttaaaatccggttttcaaaccgtttggccggcgttgtcgccgatcggtttggccgcgatgcatttatttcccgcgcggacagcgaaacgttttatgcaactgtgtctgtggcggtcagcccgcagtttctctcctgggtgtttggctttggcggcgaggccaaaatcgtttccccgccgcatgtcgcgcgccagctttgcgaccttgcccgcatggttttgaacacttaccttttttgaaaaaaggtaagccaaaaaaactttagccggctgtgcccccgcttttttgaaaaaaagctcggcaaaaaactttactcggctgcgccgcgaacagtggggcgggcactgcgcgtatgcaggctgcacctgccacggggttagatccatgggtcaggggcggcttgacggtttaccacagaacgcaccggcgtgcgcccgatacgaccgcgccgaacagaggcggggataacataaggggagggccgccgcccgcccctgccccgtgaggcgcgaaaaggggcaccgccgcggcttgttcgcgcccggcgcctatagcgccggaaagccccgaatagccggccgggcaagcgaagcggccggcggtgagcggcccgcagaccgcaggacacctgcgggagagcgccgcctgttcccagcaaaattcgtgacagacgccgtgcggctggctggattttgctggtggcctggaaaagagatttcgcgcttttgaaacccggtaaaaaaatattgccgtgtggacagaggcaatggaaaatgtatagagaaaaaatcctgcgtgaggcgatagcgcatcacgcaggatttttttgtatgaatcaaactgtacggattatgggacataatgctctgtaaaataggtagtgaaaggagtgatcgcaatgcttggagctgcactgtggtttgcggcgtcatttggattttaccgctttatgatgcggcaatgcaataaggcggccagcgcgggataccgtgcacagcgccggtacgatatgggcgtccgccgctgatggacgccggcagggcctgactgtttgaaaggagtgtcggtcatgatggaatatacgattgaatgggtacgcgggcatgtagaagtgttcgaccggacaggggcgttcctgttttcggccgacacagaacaggaggccctggctgatctgcgggagcttgaagctgcgtgaaagtaatgatataggtatgggcattcccgcttgcggcagtgtgccgcacatggtataataaccgcaaagcggttattataccgggctatgcccaacggctcgccgcttttgcgcggcaaccgccttttgatggtatggccagggcggctcgcttgcgccccgatggccgattatatcatgttcgcaaagcggcatggtattgtttatatgcctgtcagcccactgctaggcaggcaatgctgcgatcagggggcgatggcttggacacagagagcggttattatgtatatatcctgcgctgtgccgacaggacgctttatactggttggacaacggatcttgaacggcgcctgacaatgcacaatgcgggacgcggcgctaaatatacccgtgcgcgccggcctgtcacccttgtttattgtgagtccttcaacggaaaaagcgcggctatgaggcgggaatgtgcgatcaagcggatgacacgcgcgcaaaaatgcgcgctcatcgcgtgtggggatgaaggacaggaaggtaacataacatgacaatgattcctaattccgctgtgacgcatggcggacgttttcatgctgatgatgtattttcttcggcactgctcagattgctgaatcctaaaattaagattcggcgcgttatgcgcctgccggagaactttgacggcttggcttttgatattggcggcggcgatttcgaccatcatcaaaatggcgcgcctgtccgcgaaaatggcgtgccatatgccgcgtttgggcttttatggcgcgcgttcggcgaccggctcatcccggacgcggaggaagccgcgcggtttgatcagcattttatccagccgcttgatctcgacgacaataccggttgtggaagcgagacagccggtttgatcgcgttgtttaaccccggatgggacagcggggagccggctgacagatgcttttgggaggctgtttcgttcgcacaggtgattttggaaaaacgtttggaaagcgtgcggagcatgtgccgcgcgcgcagctatgtggaggaagctctgcgcggtatggtgcgtggcgttgtcacattggaacggtttgcgccgtggaaagcagtgttgtccgcttctgacgcacagtttgtcgtatatccctcacagcgcggcggattcagcgcgcagggtgtgccggctgacgatgagactcatgcgctcaagattcccttccctgctgattgggctggccgcagcgaggaggagctgccaaagctgtctggtatcgcgacattgcgcttttgtcacaacaaccggtttttgatcgcggccggtacacgcagcgatgcagtggctgcttgccacgccgctcaaaaggtctgggagcagtcgcgcggccggggttcggaaaagaacatgtgctgattgcggccaatgaatgtgcagaacaagaaaaattcagtatacaattgtaaaacttgtgattgtgccggagagagaatccggaaaggcattatcattgcgctggatcaatctttgatatgacaggaggcaggccgttgtcacatagtaaactgataaaacggggccgttcactgtatattgaccgttggaatcctgcggctaaaaaatacattcattcctgctgcgtatgcggtcaaaagggatatcgaacagaaatagaaaacgacagcttttgctgcacgcgggaaaaacaggcgatttttaatgtattggtaaaaacgatgagcagattgtcgttggatgaatggggcaggtgtgcggactgtgccggagtacaggatacaaacggttaagctctcctgccgtccgttggtacagcctgcgtcagcgaagtatctgcctgccgcttgcggcgcagccgggcgggctgaaagccaggagggagatgttaaatttgaagtatgagcgtatcgatgagctgccgcgcgatcaactgattgagctgtgcgaaatgttcgcgaaaaattggctggcgcttgacgggctgtggtttcaatccattgagaaaaaacggggaatggacgaagcggtcgaacatgatgtcaacgcttgggcgcgctttactgaaacggaggcgcggcgtatcaaagcgtttctcggcctgccggtacaggcggggctggacgggctgcgccgcgcgctggccttccggctgtatgcgcccctgaaccggcatgaggctgtacttgacggaaatacgctgacttattgcgtcaagacctgccgggttcaggatgcccgcgcgcgcaagggcatggcgtttcatccatgcaagccggtgggacttgttgaatatacaaactttgcacgcgtgattgactgccgtattcaaacggagtgtgtaagctgttatcctgatattaccgacggggaaaacaggtgcgtgtggcgttttacgctcaatgaatcaggaggccggcagtgaaatctgagcttgagaaaattcccggagtgggtccgaatatggcggcgcatctgcatgcgcttggctttgatacggtagagtcgcttcgtgggcaggacccgcaggcgctttatgaacgcgattgcgctcgctgcggcggcatactggacaggtgtgtgctgtatgtctaccgctgtgctgtctactttgctgaaacgcccataccggagcctgaaaaatgtaaatggtggaattggaaggacaagccaaatcaaaaggaggatgcgtgttgaaagccgtttatctggcgcacagcggttttttggttgacaccggcgggcctgtaatgatctttgattattataaggatacgccgcgcggcggtactttgaaagacggtgtgattgacgcgtccgcgcttaagggacgcgacgtgtatgtgttcgtttcacatatacaccacgaccattttaatccggtcattttccaatgggaggcatgggccgggcaaattcactatattttatcgcacgacgtgccaatgcgcacaggcgcggtgcgcatacggccgggtgaaaccaggacggccggcgatgcgcaggtccgcgcgctttgttcaaacgatgagggcgttgcatttctcgttaaatgcaacggcgtctgtgtgtttcacgccggcgatcttaactggtggcactggaacggcgagagcagggcgtataatgacggcatgggccagcattaccgggaacagatcgatcttttgcagggggagcagattgacacggcatttatacccgtcgacccgcgcctggaggataaatatatcctcggcgtcgattattttatgcgccgggtgggcgcggatcatgttgttccaatgcatctatgggatgattacgcgctgtgccaaaagctgatggatgacccggcggccgcgccgtactgcggccggatcgtttcatacacgcaccggggccagatactcgagctgtgaaacggcgcggcgcagccgcaggctttgatgaagcatcggacagacgtgggactgtcaatacaggagcgacagcgcccgacgggttgtttatccgggaaatttcggtgaaagccggcgcggacggcggctatgcgatggagctgccggcggtccggcggcttgggaaactggtattgactgcgccggtaaccttttttgttggagaaaacggttcgggaaaatcgacgattttggaagcgattgccatcgcctgcggcttcaatccagagggaggcacacgcaatttttgctttaaaacaagtgattcgcacgcgtcgctgtggcaggcgctgcacatcgtcaggggtgcgcggcgtccgggggacggttttttcctgcgtgcggaaagcttttataacgttgccacaaagatcgatgagcttgaccgcgaaactccgcttggcccgcggctgattgacagctacggcggacgttccatgcatgcgcagtcgcacggcgaaagttttctttcactcgtcgtaaaccgtttcggcggtcaggggctttatctgctcgacgagccggaggccgccctgtccgttacagggcagcttgccctgctcgcgcggctgcgcatactggtgcaaaacggctcgcagtttatcattgcatcgcactcgccggttttgacggcgtacccggacgcggcgatctatcagttttcacatgcgggcgtggagcgcgtttcttacagtgatacggacgcttatgtgctgaccaggcagtttttaaacaaccccggacagatgctccgggagctgtttgaggaataaaaaatgaataaaagcggacccgcgcgaaagcgcaggtccgcttttattcatctcatgaacacagtttattcctcgtcgggaatatcgtcgtcggcaagaacattagcagtatcgccagcgtcctgttcgtcgctgtgcggctgcgcgtcgtcgacctgtgtggcataataatccatatcgtacagatcgctgtcgccaaattcatcgtccagatcatcgcaaagcgcgcagctgcggcgcttgaaataggcggcaaacgcaacgatcgccccggcgatcgcgatcagaagcgcgacggttgcaataaatgtaccttttctcatggcgggtcctcctctattgaacaaattcttgaggctgcggttagttgtccctattataatcctttttggggatgttgacaagtcattatccttattttgtaccggagcagtcaaaaaaatacgcgcctgcctttttttaaaaagccgaacgctccggcgtatggcttgagccggcgcggcggcgtaaacatccctgaaatgaccgcagcttgctcttttcgcgacgctcttgcatcaaactgtttgcatccgcgatgatgaaaacgtctctgcccgcagaatgggcagagacgtcgggctgtaaaaaatgggtttaaacgatttttatcaaaggacaatgctttcgccggtcatttcggcaggctgcggcagaccgagcagcttgagcatggtgggcgccagatcagccaggcggccgccttcgcgcagctttacatctttgcagccgaagaaaaacagagggacagggttggtggtatgcgcggtaaacggcgaaccgtcgtcctcaaacatctggtcagcattgccgtgatccgcggtgatgagcgcccggccgcccatcttttcaatagcggccaatgtgcggcccaggcaggtatcaaccgcttcaaccgccttgcgggctgcctcgaacacacctgtgtggccgaccatgtcgcagttggcataattaagaataattacgtcgtattttccgctttcaatgcgtctgaccacttcgtcagtaacagtgaaggcgctcatttccggctgcatatcatacgtcgcgacctgcggcgacgggatcagtgcgcggtcctcgccgggatacggttcctcgacaccgccgttgaaaaagaaggttacgtgcgcatatttctccgtctcggcgatgcgaagctgcgtcatgcctttgtcggagatatattttccaaaggtattcgtcaggctttcaggcttgaaggccacctcaacgttcggcattgttgcgtcgtactgcgtcatgcagacgaaaaatacatgcttttggccgcctttgcgctcaaaaccattgaactgtggatcgacaaaggtacgcgtcagctcacgcgcgcggtccggacggaaattataaaaaatgatggagtcgttatccttaacaccggcgtccttctggcagacggtcggctcaatgaattcatctgtgacctctgccccatacgacttttccgccgtatcgacgacagaggggttaaaattgccctcgccgttgacaatcgcgttataagcgcgttccacacgcgtccagcggttgtcgcggtccatcgcataatagcggcccatcaccgtggctatgcggccgacgccgatgcggttcatctccgcctcaagcgcctcgagataatcgcgcccggaggtgggcggaacgtcgcgcccgtccataaagcagtgcacccatacatcgtgcaggccggcgtccctggccagacgcagcaggccgtaaagatgcgtgatgtggctgtggacgccgccgtcagagcaaagacccatcaaatgcagcgcggaattgtgctttttacaattatctatggctgcggtcagggcggaatttctgaagaaatcgccgtcctcgatcgattttgagatgcgcgtcaattcctgatagacgattcggcccgcgccgatgttcgtatgcccgacctctgagttgcccatctggccgtcgggcaggccgacatccatgccggacgcgccgatcagggtatgcgggcagtttgcgtacaggctgtcaatcgtgggctttttcgccgctgcaatcgcgttgccgtaatcgcgcgggttatatccgaatccgtcaaggataatgagcgccaagggttttttcatgcgggtacctcctattatcattcaacgcgccgccgtcagttggaagcggcgttgacaatcgcggtgaagtcggccgccttgagcgacgcaccgccgatcaggccgccgtcgacatccggctgcttaagcagctccgccgcgtttttcgcgttcatggagccgccgtactggatggtcaggccgtcggcggccgcgcggtcataaagaccggcgacgacctcgcggatgtaatggcagacctcgtttgcctgttcggccgtcgccgttttgccggtgccgatggcccagacaggctcataggcgataatgatgcggccaagttcctgtttggtcacgccggccagcgccgcctttgtctggagtccgacaatttcatcagtgacgccaagctcacgctgcgcaagcagctcgccgacgcacacaatcggacgcaggcccgcgtcgagcgcggcccgcacgcgcttattgaccgtagcgttcgtctcgccgaaatactggcggcgctcgctgtggccgatgacgacgtattcgacgcccatctcaacgagcatgtcggccgagatttcgccggtataggcgcccgacttttcccaatggcagttctgcgcgccgaccttgatattttttgcctccaggcttgtataggtgagcgccgtctccagatcggtgaacggcacgcagatgaccacgccgcacgacgcgtccttgaccatcgggccaagctcgcggatcagctccagagcttccttgcggtttttgttcattttccagttgccggcgataaccgcctgacgaagggctttattcattttgttgacctcccaatattctgttctggcacatgaaaaagcattgcttttaagagcttgaaaaaaatcaagggcgggcagaggcccgccctttgcgcactttatttattgttgagggcggcgatgccgggcagctcaaggccctcgaggaattcgagcgacgcgccgccgcccgtggagatgtgggtcatcttgtcgccgaaaccgagcttggcgacggcagcagccgaatcgccgcctccgatgatggaaaccgcgccgctgtccgcgaccgccttggcaaccgcaagcgtgccgccggcgaacttgtcaaactcgaacacacccatcgggccattccagacaacggttcctgcgcccttgatcgcctcgcagaacagcttttccgtttcgggtccgatatccatgcccatccagccgtcggggatattgtcgctgccaacaaccttgacgctgcaattggcgtcaaatttgtcgccgacacggttatccacaggcagaagaagcttgacgcccttggctttcgccttttcgagcatttccctggcaagctcaaccttgtcgtcctcgcacagcgaatcgccgattgaataaccctgcgctttggcgaaggtataggccataccgccgccgacgatcagcgtgtcgaccttatcaagcaaattgttgatgacgccgatcttgtcggaaaccttcgcgccgcccaaaatggcgacaaacggacgcttcgggtccgatagcgccttgcccatgacggtaatctccttctggatcaaaaagccgcagaccgcaggcaggtaatcggcgacgcccgcagtcgaagcgtgcgcgcggtgggcggagccaaacgcatcgttgacatagatctcggccagagaagcgaacgccttagccaggtcggggttgttctttgtctcgccggcttcaaagcggacgttttcaagcatcagcagttcgccgggcttgagcgcggcggcttttgctttggcgtcctcgccgacaacatccttggccatgatcaccggcttgccgagcagctcgcccagacggactgcgaccggcgcgagcgaaaactcaggcttgaattctcccttcgggcggcccaaatgcgaacagaggatcacagccgcgccatgctccaaaagatatttgatggtcggcagcgccgcgacaatgcgcttgtcggaggtgatggcgccgtccttgagcgggacgttgaaatcacagcggacgagtacttttttgccggagacgtcgatatcttcgactgattttttgttgtaagagttcattgctttttccacccttcattttatgaaaatcagatgaatccgtaccggtttgattgtggatttataccatgaaacattctaaatcatggggactgtttttgcaagcattttgcgcaattttccccggtttcgacaggctttgggcgctgcgcgggcctttctttggagattattgcaagcgcacgcttcccggcgcgctttccagttcctttggcaggaggtaaacaggcttaaaaatcctgttcacgtgcacgcgtattgatgcgcttttctccccgcaccagcatggcgaccaccttcggccccgagttgatggcaatcgatgcgcctgcctgataccgggcgcgcggcgcgtgcccgaattttttggaaacagccttgtgcaggtcgtctccgtactgcccgaccgatccgcagatcacgacggtcggcgattttttgtcagccgcgcgcgtataagcgtaatcgacgatgtgcgtcacgacatttttatcgccgcgcaccttttccacaaccttggttacgccgtcgatgatcgagatgatcggccgcaggccaagtacgtcgcctataaacgcggcggcgaccgggatacgccccgaccgctttgcatattcaagcgaataggaggcgaacacgatttcaactgtcgcatagaaatcgtcgagataggcgacgatttcatcggctgacgcgccgtttttcaccatctttgacgcttcaacaatcggatagccataaccagccgtataggtgcctgaatcaagaacagtgatattgatgcggcctgccgcttccggatgctcctcaaaaaactggcgcttgcccagcacagccgcctcgaacatatgcgaaccgactgaggtaatcgttgtgttgatgatatccgtatagcccgattcaaacgcatcgagataggcccgcgcgtaggtgagcgaggaaatgtggcttgtgacaggcagctccttggcgcctgccatgcgctcataaaattccgttgttgtaaaatcaacgcgttccagatagccagtactgtcgatggtaattggaatcggcaacatgacaatgccgccgtcaagcaggtcgctgtcggcgatatcgctggccgaatccgtcatcagcaatatgttctggtcgttttttttctttgccatatgcatcctcctgttattcggacggcccggctgcctcccagtcaaagcgcgtgagtctgccgctgtttaaaagctttggaaaatcccattgtcgcaacacctcgtaaaccgctacggcgacggtattcgacaggtttaagctgcgcgccccggcaatcattggcaggcgcacacagcaatcgggattctggaacaaaagctcctcaggtagccccgcgtcctcgcggccaaatacaatgtacgcgccgtccggatattgcggctcggtataggtccgccgagcctttgtggtgaaaaaataaaacggccccctgttctgtgcaaagaacgatgcactgtcgggataggtggtgatatcgagcagatgccagtaatccaggcccgcgcgcttgagtttggcatccgtgatttcaaagcccatcggtccgaccagatgcaggcgtgcgcccgtagcggcgcaggtgcgcgcgatgttgccggtattttgggggatctgcggctcgatcagtacgatattgagtgtcgccatggccgttcctttctataaagaggcgcgctcgcgcatgcgatgagccgccggccgccggggcggacggtggcgtgcggcccggacagggccgcgcgcgccgcgggccttttttcaaaaatgcaggaaattccttttataatgtaccattctttcgctggtttagtcaagcgcaggtggctgataccgccctgccgaaaaaaatttttgaaaataggcgcaaaagttgcgtttttgcgcaaattttggcctgtgcgcgggtatgggtgaaaggggtgtgatacatgtggggcgtttatgggatgcccaaaaggaaactcacttttgtgtgctggccgcgcgcggtttttcaccggaggaagccgcgcggcgctccggccttgcggacatggaaaatctactgcttggccgcgcgcgcgtgcggcgcagaattgcgcggctgcgcgcacagctggacgagatgtttccgccgcaggcattggcacgcgccggattgacgcgcatcgcgcttggcgacgcttccggcgcgttggacggacagcaggccggaggcgatctgttccatgcggccgaggtgaagctggcgaaaacaggcggcgtcgagatcaaattttttgaccgcctgcgcgcgctttccatgctggcggagatgggcggcacaagcggcggggacgcgcttctggaggcgctgtcgctttcggcgcgcacgcttgggacggatggggaggcgccggcgggtcatggataaggcgcgccgcttttccagaaaacagcttgccgcgcttacctggtggtgtcccggcagtccatatcaaaacctgtgtgctgtgatctgcgacggggcggtgcgcagcggaaaaacttattgtctctctctggggtttatgctgtgggctatgacggattttgacggatgcgactttgcattctgcggaaaaaccgccggcgctttgcgccgcaatgtgacagatccgctttgtgcgcggctgcgcgggcttggctacacagtcagggagaaccgcgcgcgcggatacatcgacgtagcgggaaagcggcgcaaaaaccggttctatctgttcggcgggcgggatgagggcagcgccgcgctgattcagggcgctacgctttccggcgtgttatttgatgaagcggcattgatgccgcgttcctttgtcgaacaggcattggcgcgctgctccgatgaacgcgcgcgcttttggttttcctgtaatccggagcatccgcagcactggttttacacagaatggattttacaagcgcatgagaaaagcgcgctttacctgcattttaccatgcgagataatccttcgctttccgaagccgtgctgcggcggtatgaacgcctgtatgccgggacgttttacgaccgctttgttcttggaaagtggacagccgcgcagggcgctgtttatcccatgtttgatccggctgtacatgtggtggagcacgcgccgcaatgcggacgcttctacatatcgtgcgattatgggactgtcaacccggcgtcctttgggctgtggggcgaaagcggcggcgtatggtaccgcattgcggaatattatcacgattcgcgccgtacaggcgaggtaaaaaccgatgagcagtattacgaggcgcttgccgcgctcgcgggggaaaggcgggtggaggctgtgatcgtcgatccgtcggccgccagcttcatcgcctgtatccgccgtcacggccggttccgcgtcgtgcctgcccgcaatgaagtggccgaaggcattcaggcggtcagccgccgcctgcgggaaaaacggctcttgttctgcgcctgctgtgcggatattctgcgggaattcggcctgtaccgctgggatgagcgcgccggccgcgacacgccgcttaagcgcgacgaccacgccatggacgatctgcgttattttgtgtcgaccgtgcttgagcgccgtgggacaggcttctgtgtggccggggttggacgggagacggcccccctttggaaaaggggggcggcgcgcagcgccggggggattgggtaagccgctgggcaggcggcgaaggcccgcgccgcagtgcgcgggcgcgaaaaggggtgcgggggaaacgattgggttcccccgtaccgggaggaggaagatgaaaatgcgtttgtggaaacgtatgaaaaagaccgccgcagccgctgtacagacagcgcgcggacgcccggcagcagataccgtacagccgccgcactggcgggaatgggccgtgtacgacgggctgcgccagtcgatccctgtaattgacgcggccatcggcaaaatcgggcgtcttgtcggcggctgtgcgccaatctgcactgaccagcgggcgcaggccgagctggaggcttttttcagagatgtgtgtgtcggggccgccgcacgcggcatggatgcgtttatccggtcttatctggacagcctgctgacctacggcaatgcggtcggcgagattgcggcggcggccgacggccggtctgtggcagggctttacatcgcgccgctttcagatgtgtgtatccgtcagggggcgtcgccgctggaggcaaaaatttatgtatacagggatgggattacgccggcgcccgcgccgtatccagaactgatcctgttctctgcgctggatccgccgcccggtcaggtttatggatgctccttgctgcggggattgccgttcgtatgcgatatacttatgaaaatatacgcctcgatcgggcagaactttgagcgcatgggcaatctgcgctatgcggtgacatatcgccccggccctgatgcgcccgatcagacaggggccaaggagatcgcggacagtatcgcacgcgaatgggctgatgcgatggatgcagcaagacatggtataattcgggattttgttgctgtgggcgacgttgatatcaaggtgatcggcgcagacagccaaatggtttcaaccgaggtgccagtacggcagatgctcgagcagatcgtcgccaagcttggtgtgccgccgtttctgcttgggctgaattggtccaccactgagcgcatgagcgcccaacaggcggatatcctgacctcagagcttgagagctacaggcgcctgctgacgcctgtattggtcaaaatctgtacagtattcctgcgtttgcgcggctatgcgtgcggcgtggacatcgtatgggagaacatcaatttgcaggatgaattggagcttgcaaacgcgcgcctgaccaatctgcgggcggatcagctgcagacgcaacttgaaaacagacaggagggctgatatgaaacacgcaatggtgacaaaagctgttgacagcgcgcaggttacagaggaacagcttgagcagatcagcgcgttcgcgcgccgtccgcttgctgcggacgaggtttatgttttttccatgatcctctgcgacaatgagattgaccgcgattatgaacggttcccacggcagtcattggaggtacttggcaggctgttcattggcaaaaccggtatttttgaccacaatccaaagggggaaaatcagaccgcacgcatctttcaaacaaccgttgaatgcgacacacaccggcacacacaaaacaatgagccatactgcgcgctgcgcgcgtgggcttacatggtgcgctgcgcaaaaaatgccgacctcattttggagattgacgcaggaattaaaaaggaagtcagcgtcggctgcgctgtcaagggcgcggtctgttccatctgcggggccgatacccgaaacgaaccgtgcgcgcatatcccaggccagcagtataacggtacgctttgctggcacgaactgattgaaccaaccgacgcttatgagtggtcgttcgtggccattcccgcgcagaagcaagctggcgttacaaagggatattcttcagaaaacacgcggccaaagcgtgcgcccgacggatcgctgacgctgtcaaaggcccaggcagacgcgcttgatatgcgcctgtctgaattggagacgcttgctcgggagggccgcgcgcgcttggagcaattacgccgtgattttgttcgcatggccgcgttcgccatgcctgcccttgacccggcggccgccgcagagacggccgaacggctcgacgcacggcagcttgaggcgttctgcaagggcttttcagaaaaagcgcccgcgtttctgcagcttggacgcggggaaaatatgcagccggaggacaacggcgtattccggatttaaggcagcggtaaacaaacggcgcagccttttagtgaaggttcgaagaatgaacgacaaaacagggaggaaaaaagatggcgaattatcagacaatcaagcttgacaaatctatgtaccgcgcggggattccgtttaccgtacagcttgaaaagctcgatccgtcggcgcagtatgcgggcggcgagctggccgggctggacgcgtttgagcggcagctcaaacgctttgacatcaaagtgagcggcgcgggcagcgacacgatctccaaattcttttcaacaggcgattctgccgctttgtttcccgaatatgtgtcgcgcgctgtgatgcagggcgttgatgaaagcggcgtgctttccaacatcatcgcttcaaagactgtgatcaattcgctcgactaccgcaccatcaccactgccgatggacatgatacagccgcgtccgtcgtgcaggagggcgccgaaatcccggagacggtcgtgaagctcaaggacaatcttgtcaagctgacaaaacgcggccggatgctggtggcgtcgtatgaagcggtcaaatttcaaaggattgatctgttttcggttgtgctgcgtcagatcggtatgaacattaccaaggcgcagcttgctgacgctgtcaacgcgctcatcaacggtgatgccaccgatgacgcaaacggcaatgcggcggcggccatcgaaaccgcgcaggccggcacgcttacatatgacgatctgcttgcgctctggtcccagtttgaagatttccgcatgaacacgctgattgtcgcgcccgacatgatgcagaagctgctggccattgaggagctgcgcgacccggtcgctggactgaatttttccggcagcggtatgatcggcaccccgctcggcgcgaatgtaatccgatgtgccgccgcgccggccgggacgattgtcgcgctcgacaagaatttcgcgctggagatggtgacggccggagatatcctggtcgattatgacaagctgatcgacacgcagcttgaacgcgcggctgtcacgtccatcagcgggttcgcaaagctgttcccgcaggccgtcaaggtgttaaagctcaagaagtgaccggggagctgggcgacgaaaggcgcgggccggacaggcccgcgcacgcgtgcggcggccgccgcgcgcgaaagccgcggaaagcggcttctttcgccgccttcgcaatgggggtgcgggggaaatgtgttcccccgccctcacaagcagaaccaggaaaaggaggaaacatccttggaaatagaagccgtattggaacagtttatgcgcctgtccggccttgacgagcaggctgcgcgcgaatggaccccgctgtgtgaagcggcggccgaacgcatcgaggagcttttgccagtggatgcagacccgaacaggctgcggctgattttggctgcggccggcgaagcgaactaccgatatatgctggcgcgttcgaccggcaatgcgcagagcttcaaggttggagatatttcagtgacgcgctcggaggagggcagttcggcgcaggaagcgcgcgccctgcgcgacgcactgttcacggacgccgcgccgcttttcgcgcgcggacacgtgggactgtggcaggtgatggaacgtgaatctggaaacgtcggtcaatgaggcgctgcgggtctgcggccagcttgtcacagtgcagggcgacaaacaggcccggttttatgcaagtatccagccggccgggtggaacacgcagatgcgcaccgagggcacatatacgcggtttggccggacggatccgcgcaggttcttttactacggtcctttgacaggcggcggagagcatgtttgtgcgggtgcggtgatcaagaccgggcaaaagctctatgaaattttgatttgtcatgattttgaatacgggggcgcggggctgttcagatgggcggaagcgcgtctgattgaaggagggatggaggatggatgcactgacggcgtttaaaaatgatctgacgcgttatctacggggcaggctggcaacagctggagatgtgcaggtggccggggaatatccgcccgggctgcaaaaacggccgcagcggggctgctgtgtggctgtcggcctggatggggccagccggccgggcgacgcaggcggacgcgtccggctgaccatgcgttttgacatcatctgcccggttgggcagcagccgggttgtcacgcggtctatgaggaactgtgtggcctgttgttttgccgtgaaaatgccttcggcgcggcgcagatcgagtgcggcgagctgacgtatgaccaggagcttgattgcctgtctttgacagcgcgcgctgttctcaacgggatattgaatgaggagccggatacggacgggctgccgtttaaagaaattttggttcatgcggaaaggatggagcgcgatgattaacctgccggattccatgcggcccggcgtctataccagtacggatatacgcatcggtacggcggccgcgggcacgcgcgcggctattgcggcggtgggacaggcgaaggccggttatgagccggctggtacagcagtggaggtgcgttcctatacggatgcgtctgccttcggcgaggaaagcacgctgtgcgcgatggcgcgggcgctgcttgctgggggcgtttcacgggtgctggcagtagccgtcggcgcggattatgaagcggcgttcgccgctctggagggggaacgcgatctctttgccgttgtaagcgacggcgggggcgcagctttggcgcgccatgtcgatgcgtgctgtgcgatggggcgcgagcgcgttgggatcgtggctgccgccgaagcggaggcggcggtcgcagccgccgcggagattaacaacacgcgcgtggtggttgcgtgcgacgcagggacgcgcacggccgaagtggcggcggcgttcgcggcggccgccgcgaacgccgccgggacaaacagcctcaacggcctgccgctgcgtctggagaaaccgtttgacggaatgctgacggctgttcagatcgaaacgcttctgcgcgcgggggtagcgccgtttgaagggcgcggtgagggcgcggcatgtgtgcgcgccattacaaccggacggaccggcgatgcgtcagaagggcctcatgccgcgctgtccacggcgctggctgtcgacgcggttgtcaccgcggtgcgcggtgcggttggcacgcgcctgcgcgggctgaaaaacaatgcggttacacgcgagagcatcgcctcgcaaatcactgtggaactcgaggccaagcgtgcgctcggcgtaatcgacagctatgagccgccgcgtgtgacggcgcatccgtgcgacgcgtccgtctgtgtggcgacgctgtccatgcgcgtcgcgcctgaaatcagtcagattgtcgtcgcggcggagattgtcgtttgaatgcgaaaggaggcaggcaatggcatttatcacattcccgacaagtaaggatatctatatcgaaattgatgggcgccgccttgccacggcacagagctacaaagctaggacaacgcgcgaaagccgctatgtggaggcgtttggctcggccgagccggttgggacggtcggcgggcgcgtacgccatgtcctggagctgacgcgcgtggctgtaacgccgcagatggacggcgataccgtcgattttcatgcgctcgacggctttaacgttgtgattgtgcgcccgggcagcaaaattatttattctgattgcagatggtccgcaattgatgaatcaacgccgctgggcgaccttgtatatgagacgctgacgctggtggcgcgcacgcgcatggaggtgcagacatgaaggcgggaccgcttgccgaaaacaggttttccgctggctatctcggccgggactttacctttcaaaagcagagcgcagccatgcggctggcgcaccagggccgggcgcgggagatggtcccgcggctgtgcaggctggggcttgacgaggggcaggcgtatgcgctcgcctataactgcgtcctgctgtttcagacattgcgcgggcaggacgccgtcccgtcgcccgagggggcgcttgaccgctttacgctctgtcaaattgctgatttgtgccgtctttattgggagcacagcgatcaggccttcgacagggcgcgcccgccggcggacgcggtatggtacgacgagtgcgcggtcaacgaatcatgggacgcacagactggggggacggaatgaatctggaagcggagcttgcggcgaacatgaaggtgttttccgactttacaaagacgcgcgcggctgtcaattatccggcaaagatggatgtgccgcttgtatgggatctgtatatggatacggcccggcctgtgggccaaacgcaggaaactgcatccattacggcggccaacggacaatccacaccagccgcgccgctggaagcggttcgtcaggcggactacacgccgcagccgatcgcctatacgcctgagcagatgcccgccgcgccggagcggtccggttattatgaagcggcggacgacgatacgcaaatgctcagtctggtcaacgaccgcctgcgtgcacaggcgcgcaggtatccgcatccgattacaaatgaaatggaggcgattcattgaaccggatgcagtttggaacatatctgttcgaccagaacccgcgccggattgagctgtcccaggcgcataatctggcggcgcacacattgccgggaacgggcgtcgccatgcaggatacaggcccgcgctgccgcacggcgcggtgcgagggggaggtcttcggcgatacggccgacacggccctggacaggctggcgtcgctggcggctgcctgcgcgcccggcctgcgcgggacgctgtacctgccgaccggcgagcaattcactgcggcggtcagccggtttgcatacaccgcgcagggcgacgggcgggtgcttgcatatgtgatcgactttcttgaatatggcgtggaggccgcgtcatgacggcgaggctggacggggtgctgactgtgacggcgcgcggcggcgacggcgcggcggtgacgctgccgccgccggttgaatgggagcttgtgcgctcgttcgattcgccggctgactcctttacggcggtattcccgtatgaacaggcgtgcgggggttttcattcggttgaggcggtcatgggtgaacggcggctcttttacggcggcgttgacgaaacgagcgtgacggccggcgcggcgggacggcggctcaagctgctggcgcgcggacccggagcggtgctgctcgacaatgaggcgctgccatggatttatacgaatgtcgatttgcagcggatttttgacgaacacatcaagccctacggctttgaaacgctcgtgtacgacaacaacgcaatttttaaccattaccaggtgcagaagggcatgagtgagtgggaggtcctttataattttgcacgcaacgcgtcgtccctgccggcgtatatcgacagtgaaggccgtgtcgtctgtccgagcgaatggccgtcggcgggcagccttgttgtttcaaacagcgtctcggacgcgctgcgtttttcaagcgtcaaggttacggacaaccgttactcaccgatcacgcgttttgtaatccgcgatgaggagggcgtttacagctattcctacgacaatccggaggctgacgcgctcggactgacgcgcatacgttacttgatcccttcagtggaatatatgcagggtacaagcggcaggcttgacgcgtctctgcgcgtgcaccgctccatgctcggcaagtttgtagccgaggcagtctgtcccggcttttgggatgtggcgctgcgcgattcggcaaggctcgataccggcgtgcagatctatgaggacctgtttgtccatcaggtgcggtacaggctgtcgcaggacggggcgcagacctttttaaccatgctggacaaacggtatgtgtaacagcttaaaaaaggaggcggatgccgcatggatgttttattggaaaacggcgacattgtgtgcgggcgcgatggaacgccggtgatgatcggcggcgcgcgtgagctggcacagcgcgctgcgatacggctggcggtccggcgcggaagcctgccgcacgatccgtcgttcggcagcgagctgtaccgcctgcccgccgcaggcggacaggcggcgcgcgacgagcgcgccctcgcgtatgcgcggcgcgcattggcgccgctgccgcaggcgcgcgtggccgcagcgcgaagcgaatgggatgcgcaaaacagccgcctggcggtgcgcgtgacgctcgatctgggcggcgaacaggcgggattggaggtgcggatttgatgcaatatgacgaacagtcgctttatacgcgtatgaccgcgcgttatcaggagcttgcgggctttgttccggacgaagcgtcggacattgcgctgcgctttcacgccctggccggggagctggcgcaggtgtgcgccgtactcgacgaggcgcgccgtcaggccgcgcctcagacggcggccggcgaacggctggagctttatgccgggctgcgcggacttgaacggattgcggccgcgcatgcgtcaggtacgcttgtatttaagcggtataaaaccggcggggaggaaatggtgcctgctgggacattgtgccttgccgcggaccaaaccgcttatttaacgctggaggacgcggcgtttggcgacgggcaggaagaagcatccgtgcctgcgcgcgcacgtgaaccggggcgcgcgggaaacgcggcggcgggacggattttaaagatcgacccttccctgccgaatatttcggtgaagaacccggaggcgtttacgggcgggcgcgacacggagaacgacgcatcgctgcgcagacggctgctcgacgcgataaaggaaccgccgaacggtgtgaacgcggcgttttaccgcgattttgcgtgcaatttccccggtatttctgacgcggctgtacaggccggcgtgcagatgggcgatgtggagctgcttgtgacggcgccggatatggagcaggtcccgacagatgttaaaatggctttggaggcggcgctcgatgaacgccgcgcgctctgcgcgtcggtaacggtgcgggatgcgcagacaataccggtcgatgtgcatatcaccgtacagcctgcacaggacattccgtttgaaacggtacgcgcatccattgaggcgcaggtacgcgccctgcttggtcaaaagcggctgggagaggggctgacgcgcgcgcgcctttatcagcttgtgatggccggcgaagcggaaaactgcaacgtcctcgcgcctttaaacgatcagactgccggccctgtgcaggcattgcgcgcgggcgttataacggtggaggagatgggggcttcaaatggagcatagtctgtacgcacgcaccgcagccgctggaatttacgacctgcggccaggtacgtctgtttcgaacgagttggccgcgcttgacgcgggactgtcccgggcgcgggaacttttgtcggacataacagatgccctgtacccgctgtccgcaccgtatgaaatgctcaaagcctggtgtgcgctgcatgggtatggcgtcccgtccggtttggacgggacgctgctgcggcgcgcggccgcggcgctggcgcatccgcccggctgttcgcgcgccgcgctcgaggcgtattttcgtatgctcggctgtgcggtcaggctgaccgagcagcctgcgcagcgccgggtgctggttggcggagaaacgtctggcgggctgtttgaggacagcggcgcgctgatgcgtgcgctgcgccggttgctgcccgtgggtgtgaccgccgcgctcgatatcggcgaactgacctgggcgctgcttgacgcaatggaactcgacgcggcggcaatcgacgcgcgcgggctgacttggagtgaattcgacgcggcggggcatcccgcgccaaaggaggcaatttgatatggccagtacaaataaaacagaaacgcttgggctgaaccagtggatcggttcggataaaccaaagatggaggactttaacagcgacaatcgtttgatcgataccgccttagcgggacaccgcgccgaccagaccgtccatgtgagcgcgcaggaacgcgccgcatggaacgcagccgcgccggtcatcggttcttatacaggcgacggacaggaggaacgcctgattaccttggggtttcagccgcgctttggaatggtattcgctgtggataaaaatttggtcggcatggccagccaggcgggtgatatgattaattattctgcatgcgttgcggcgcaggggggatcggcgggcgcttatattgaggagacgggatttacagtcatgcagctcatcgcggcgacaaacagatcggtgcccaatctaaatacaaaggacgtaacctatgtatatattatgttccggtgacagaatttgtgggaaaatttcggcataggtattgctttttggtaaaaagaatgctattataacttgtactgtcttttatgcaatccaagcaaggaggtgtaaacctatgccgaacatcaaatccgccaagaaaagggtgcttgtcgccgctaaaaaagcgcgtgcgaacaaggctgccaggaccaacctcaagacggttctgaagaaggctgacgccgccgtttcagcgggcgccgccgatcaggccgaggcgatccgcgtcgcgattaagaaggtcgatcaggccgctgcgaaaaagctgatgcataagaatgcggccgcgcataaaaagtccgcgcttatgaaaaagctcgccgccgcctccaaataagaagggtcggccgggtgacacctgtttcttatcgacactgccgttttcgcggcagtgttatttgttttttagccggttgacggccagacatttttgcgatatcatagagccagattttgcattctgccgccgcatccggcggataaaggggggcatgtttatgcatgagcacagcacggaaaagacgtttctttcgcttttatggctggtggtgccgattgttttgtcaattctggtgatctgtgttaccgccggctactgcatctatcgccgcgcaatcgaacgggcctatcgcgcccaatgggatgattatgactatggctgtgacgtgcccgagattcaggaatgggaataagggttgattgatgtccccggcggagctgccgaaaggcagcgtgccgggggcttttttcagaaaggtcggaaagccggagtttgcaaaagccacgccagccgcgcggtatttgtcatggcttttgctgggggtgggagatacgtctgaacaggctcttgcggcctgcgggccgcgctttggcgcgcgcgacccgtgcgcgggccgctcaccgccgggggcgcgcgcaatccgtgcgcggattgctcaccgccggacgcttcgcttgcccggctggctattcggggctttccggcgctatagcgccgggcgcggacaagccgcggctgcgcccctcagcgcgcctcacaaggggagggtcgagcgacccctccccttatgttatccccacctctgcctggcgcgatcgtatggggcgcacgccagtacgtccggagggggatcgtttaactgaacctgccctggaattggagtgcttgcaggaagcgcgccagccacacggcgtctgtcacgcttcctgctgggggcaggcggtgcgtctgaacgggtgtcttgcggcctgcgggccgcactttttatgagggctgcggcccggggataagggcgctgcccttgaaaacggccaagacccgtgaggggccttggccattttctcacccgccgcctcccccaaaaggcgggcgaaaacttttgagcgacgcggcgtaaatcagatttactgcggctgccccactattcgcggcgcagcctgtataaacgcagtgcctaacccactattcgcggcacagccggctaaagttttttgccgaggctttttttcaaaaaagccggagcacagcctgtatatgcgcagtacccgccctactattcgcggcacagccggctaaagttttttggcttaccttttttttaaaaaaggtaagtttcaaaaaagcgggaacagcatttgttcgatgaagcggtcggaaaagaaggcgctttcggtgagatcgagcacctgagcgcgcttggcgagacgctcggcgtcgtcgagcgcagactgcgacgacgcgatcaggcaggcccccgccccggccgcgttgccgcaggcgcgcgcgcgcggcgcgcaggccgggggaatcaggccgataccggcggcggaccgcacgtcgatgcggctgccgaagccgcccgcaagcagcagggcgtgcagatcggacggcgcaaggccggcggcttggagcatggagtcgacgccggcggcgacggcggccttcgcaagctgaagctggcggatatctgcctgcgtcagcgccacgccgtccataagcggaaacgattcgtgatattgttcgtcgagcaggccggtttcgtcgaccgctttgcagtcaagcaatgcggcaagggcgctgatcgcgcctgtcccgcacaggccgcgcgccgcgccgccgccggcgactgtgcagacaacaacgccgtcccctgctatggaaacacccgtgatcgcgccgtcggccgcaaccatgccgtgtgaaagcccggcgccttcaaaggcaggcccggccgctgtcgaacagcagaggatgcccgtcccggtgatcagcgcaagctcgccgttcgtgccgacgtccatcaagagttcattctcctgcggcgccgccgcgagcagcgcacagatcagatcgccgccgatatacgcgccggcgcacggcgcaaaatagacaggcacgtccggcggcagagcggcgaacaggctgcgcgcgctttccatcacgccgaacaggctctgcggcgtatagggtgcggctgcaatcccggcgggatcaagcccggctacaagatgcagcatggttgtattgcctgtgagcacgacgccgcgtacaacgcgcgcatcaaggtcgcgccgcttcagcagagccgtgaacaggccgtcgagctgcgtgaggatcgcctcctggagcggacggatgccgcattcggcgcagcgcgcgatgcgcgcgatcacatccgcgccgtatggtgcctgcgcgttgagcgcgctggccgtttccataggttgggcgtgcgtcagattgaccaggtaagctgccaccgttgtcgtaccgatatccacggcaagggcatagccatccgtgccgaacggcgaggcgtcgctgcgctgtgcggacaggccggccgtttcaatccgggcgttttcgggtgcgcgcgcatggacggtacagccgccgagcgcctgcgcacagcaggcgaggcgcacgtttgaaagctgctcatcggcagtcagcaggcgcttttccgcttcggacagcggcgagagcgcgccatatgccgcaaccttgcatttgccgcaggtgtgcgcgccgccgcacggcatgggaaagccatacggctctaaaaaagcggacagggttcggggcgcttcatacggtatcctgtgggccgtaccgccgatataaattgtgatggtttccataataaatgtcctttcagttgctatgtctgcgcgccgccgcgcagaagccaacacgctgccagcgcgctgaacaacccaagcagcgcgcccgccaggatatcggttggataatgtacggagagatacagacgtgaaaaggcgatcagcacggccatcgggatagcccaccatccgtttcgccggttggacagagtcagcgaacatgcggccgcgaacgacgagcctgtatgccccgatgggaaggaaaatgaaccgggcggcgcaatgagcagcgtcaaatccggcaggtgggtaaatggccgcgcgcgctggacgatgtttttgagcacaatctctccgcatacaaacgcaatgagaagcgagagtgcgcaggcgcagcccatacggcgtgtctgtttgcgtgcgagcaggaaaatacagactgcaatccagataaacccatattccccaagcatggtgatgaccggcataagaaagtcaagaggcgggcagcgcagatgtgtggcgatccagttgacaatggtcagatccatgatattctcctttatcaaatgcaatcgtaccagaggtatgctgtggccggtgtcaatagagacagatttattttacgtgattttatgaaaacaatcaatgacaaatcgggaaatcattgctataataagcggtaagcgattattacagcgtatggccgtagcgcgcgtgcacggcccgattttgtcccggcggtcaatgcagcgccgtgcgtagcgggctgctgtcataaaagcatatgcgccggcccggccggatatggtcacaggctgggatgaagcgaaggtgaggaggattacgatgtctatttcaaaggaactgatgctgaagctgcaaaacggcagcgatgtgcgcggcgtcgctgtggagggcgttgaggggcagcaggtcaatctgaccggggaagccgccaacctgatcgcacaggcgtttgcgctgtggctggcgcagcgcacgggcaagcctgccagcgaattgaaaatcggtgttggacatgattcgcgcgtttcggctccggcgcttttgttgcaggtgctccaggggttggctgtacagggtgcgcagccgtttgactgcgggcttgcgtccacgccttccatgtttatgtcggtcgtattccctgaaacccgttttgacggttccattatgattacagccagccatctgccttataaccgaaacgggcttaaattctttaacgcggacggcggactggagcacgccgatatcaccgacctgcttgaaacggcggctgtcctttcggcgggacaggccgacatttccaaggtgtcaaaggtcgacctgatcagcctgtatgcgcaaagcctgtgtgaaaaaatccgccttggcgtcaaagccgacgattacgaccgtccgctggcggggctgcatatcgtagtcgacgcgggcaacggggcgggcggattctttgtccggcaggtgcttgagccgcttggcgcagataccgccggaagccagtttctggagccggacggcatgttccccaaccatatccccaatcctgaaaacaagcaggctatggattctgtgcgcgccgcgacagtggagcatcatgcggatatgggtattatatttgatacggatgtcgaccgcatgtccgcggtcctgcacgacggcagcgaggtcaaccgcgacgctatcatcgcgatgatttccgcgattattgcaccggattatccgggcggtacgatcgttacggattccgtgacctcggacaagctgaccgattttctggagaacacgctgcatctcaagcatcaccgctttaaacgcggctataaaaatgtgatcaacgaatccaagcgcctcaatgcggcgggcgtacagtcgccgctggcgattgaaacctcgggccatggcgcgctgagtgaaaactatttcctggacgacggcgcatatcttgccgtcaagctgttgattgcggccgcgaaggcccgccgggagggcaagcgcatcgatacgctgatcgaaaaactgcccaggcagtttgaatgccgcgaataccgcatgaatatcagcggagaggactttaaagcatatggccagcaggtgctcgagcagttcgagcagcgcgccagggccgccggttacgctgtggcgcccaactcttacgaaggcgtgcgcctgacgtttggcagcgagcaggtccagggctgggtgctgcttcgtttgtcactgcatgatccgcttatgccgctgaatatggagggcaaccgtcccggcgactgcgaccgtctctgcgctgttgtccgcacccttctcgacggctttgaccgcctcgaccagtccaagcttttttgaaaaaatgcctagcagaaaactttagccggctgcgcccccgcttttttgaaaaaaagctcggcaaaaaactttagccggctgcgctccggcctttttgaaaaaaggcctcggcgaaaaactttagccggctgcgccgcgaacagcgggtttggcgctgcgttgatacaggctgtgccgcgaacagtggggaaggcactgcgtaattcgttttacgccgcggcggtcaaaagtttttgcccgccttttttaaaaggcggcgggtgaaggagaaggacaaggccccttgcgggttttgtccttctccgagggcagcgcccttatccccgggccgcagccctcataaaagcgcggcccgcaggccgcaagacacctgttcagacgcgggaccctgcgtcagcaggaagcgtgacagacgccgcgcggctggcgcgcttcctgcaagctccccgccttccggcctttttttctaatcggaaccctggccagtttttatttagaatataaccttgagaggatgaatctattttgaacagcagcgaaaaaaccatggaaaagatcgtaaatctctgtaaaagccgcggatttgtttatccaggctcggagatttacggcgggctttccaattcatgggactacggcccgctgggcgttgaatttaagaacaacgtcaagcgcgcgtggtggaaaaaattcgtacaggaatcgccttacaatgtggggcttgattctgcgattctgatgaatccgcaggtatgggtcgcttcgggccatgtaggcggcttctccgatccgctgatggattgtaaagactgcaaaacgcgccaccgcgccgacaagctgattgaggacgcaaccggcgaggtcgcggacggctggagcaatgagcagatgctggcgtatatcagggaacataacattcaatgcccggagtgcggcggcacaaattttacggatatccgcaagttcaacctgatgtttaaaacgttccagggcgtcactgaggatgcgaaaagcgaactttatctgcgcccggaaacggcgcaggggatctttgtcaactttatgaacgttcagcgcaccacgcgcaaaaaggtgccgttcggcgtctgtcagatcggcaagagcttccgcaatgaaatcacgcccggcaattttattttccgcatccgtgaatttgaacagatggagctggaatttttctgcaagcctgatacggatttggagtggttccagtattggcgcagcttctgtgaaaactggctgctgtcgctcggcatgacaaaggacaacatgcgcctgcgcgatcatgccaaggaggaactgtcgttctattccaaagcgacgaccgatattgaatatctgttcccgtttggatggggcgaattgtgggggatcgccgaccgcacggattatgatttgggacggcacggcgagcattcgggcaagacgctcgattatttcgatcccgagacgaacgaacggtatgtgccttatgttgttgagccgtcgcttggcgcggaccgtgtggcgctggcgtttttgtgcgacgcgtatgacgaggaagtcgtcggtacggacgcaaagggcaaggaggatgtgcgcgttgtgatgcgcctgcatccggcgctcgcgccgtataaagcttgcgtgctgccgctttcgaaaaagctggctgagggcgcggggaaaatctatgagacgctcgcaaaggaatatatggttgattatgacgacgccggttccataggcaagcggtaccgccgccaggatgagatcgggacacctgtctgcatcacctatgactttgaaagcgaaactgacggctgtgtaactgtgcgcgaccgcgacaccatggcgcaggagcggattgccattgattcgctctgcgactatctcaagacgaaaatcgcgttttaaataggaaaatgaggggcggtgcgaagcaccgcccctccgattattttggcgttgaatcatccgttaagccgagcagataatcacaactcgtatgataaatggatgataggcgtaacaatacccatactggtatatctgtatgcccgcattcatatgcgctatattgttgttgactgcaatacagtcgtttggcaagctgctcctgcgaccaatgatgtttttttcggagatatcgaagcctatcatacaacgaaatcaccccggtgtcatcttatcatatccatcatctgatcgccgttgtttagcgaaaaaatcgctaaacaatttattataccaggagcgcaacaatatcttgacatccgatgaaagcgtatggtatgataactaagttatcatcgaggtgtagcgcagttggtagcgcgcttggtttgggaccaagatgccgcgggttcgaatcctgtcacctcgaccattccattaagaagtcgaacaccggaaacggtgtccggcttcttttttgcgtccggggtttcggcggaatctgcgggggccggttcatcgtcaaggccggggaaaccttcggttgcgtccagcatgtcaatataggaaacctgcttgccgccgcggatgttgtaaaacacaacaaccctatcgtcatacaggtacacggaatttataaacgtgtcgataatccgccgcctaaattccatgtcgaacaagtcccccttgcagaacaatttcagccacgccacaatttccgcttcggtatagcggattttgtttgcaatgtgcagctttgaaaggtcgatttctaaatcgaccttttgcatatcggcagtttcgattttctcataaatccgggggcgggcagatttgggcgcgtcaagcagcatttcggtatatttatctatatccctgtccagcttggcaatttgcctttcaagctctttcaccttgccgctgttaaattcgctgtcatattgggccacaaccgccgcggcgatttcctgcatacgccccggggtgaggacatataaaaccgtctgttccacaacataccattcaaggaaatctttcttttcatgggctttcttgcagcccttgcgaagccgccgattacggcagcagtaataatagtgaatatccccgtgccgccccgtgccggaaacccctgtaatggtttcgccacagtagccgcaaaaggctttgccggtcaacaggtattctatttttgccttattcttgccgccctcccgcttgttcttctttatacgttcctgtaccttgtcgaaggtttcccggtcaatcagggccggacagccgttttctatcacaatgtcattccatcgaaggatgcctatatatttttcgctttgcaaagcaacctgcaaagcggtattgccgaagggctttccgtttcggttccgcaggcccgccgcgttcaattcctctataatctgttttttggggacccccgcggcatactgttcaaacgcctttttcacaaagggggcctttgcttcgtcaatgacaagccgcccgcccgcgctcttgtacccgaaaggaataccgccgccgcaaaactgcccttttagggcgctttcccgcataccgcgttttatcttttgggcaagctccaaactgtaatattcagcgcttgcctccagcacggcttcaagtatgatgctttcggggttgtccccgatattttccatagcggaaataacctttaccccgttttgcttcagcttgtgcttgtatatggcgctgtcatagcggttccgggcgaaacggtccagtttataaacaatgacatactgaaacgcccgcttgcgggaatcggaaatcatgcgctgaaagtccggcctatcgtccgttttaccggatatggcgcggtcaatgtattcccccacgatggtaaaaccttcacgctgggcgtattcatggcaaacgcgtagttgtccttctatgctttgctctgtttggctatgtgaggaatagcgagcgtatataaccgcatttcgggcggcggcggtttctgcctgtttcataaaatgcccctttctttcccccgccccttgtggtacaataaagcaagggtatattgtattttgacagtgtgcaattatccttacagttgccgcccaacgttgcagcgttgggcggctttctttttactgtgataaaaattccagatattcggatggaggaagctggcttgctaatgcgttgatagatttagagccgctataacgggaaagtttgaggccgaaaatatgtgctttatgcgcaagtttttccgttaccggggattcgtcattatctgtaattcgtgagattatggcgctaacatcgtgtgaacatgctccatcgggaatgcttgcgcctaaactcttggcgtatgatagttgagattcggaaggcggtttagatgggagaacggaaacttcaaaaggaccaactaaaccgcttgattctgcatgagagcgggcttcatcttcgttacggacttcgtaaacacgtttgtttttgcggttggtagcgggatttttgccaataacctgaaatcgtccataatttacgaaaccgccagagggtgaaatatatccatctaatgccgaaatggggattgccggaagtgttccagatgttttttgcacaacattgtcataatgtgaactaaatgctgttgtaatttgaatatgagtgtcaaggggagctttggacgggcgtttaacttgcgttgacccgaaaagttttgcaaagaaacccataaaacaacctcctatcaaaagagattacagacttatgccggtctggaatccgtatagaccatatccgggcaaaggtcaacatcttcattccaatagacgcacattccgtccgcctttgcggtatcaaagaaacccttgtttttcaaaggggcatacagcggcagggacaaaatgggctttgcgtcaaaaatctttttttcgccattctggaatgtgataagcaattcatagttttcaagcggtgtcacagcaacaggacgcggattcatacacttacccccttgcgcagggccgtttttgtcaaaacaaattgcggaatatttcttcgagcgggattgtgaaatcatcatagagggaaaccgggacttcacttttatagtgttcctgttcatctgcggacagctccacatagtccgggaaaaccttatagacttcatccaatacaaatttttcatttttcagcaggtatacttctactgtttgattttcagtgtccacaagccaatattcccgcacaccgcatttttcgtataaatctttcttgtatccacggtctttcttttctgttccgtgggaaagaacttcaacgattaaatccggtacgccgtgaatgccgttgcgtttgattatctctttcttgcagataatcattacatcgggtacaaccctgtctttttcagtcaagtatacatccgtcccgtccgcaaagggcaggcatttctttccgtctaaacgattcgcaaacgcccggtagatattgcccatagcaagattatgatttacagcgggccgcggggacattagaacaaccttgccgtttaacatttcgtcccgcaattcctcttgatatgccagattgtcagccataatatgaaacctccatttcttgatgccgcctgtttatacaggcggttttttttattttcgtcaatgaatcccgcgaattgccgcatgatgccggacagcagcggggcggtttgggaatcagcggtaaccccccgcacataggccagggccgcgccggttcgcgtgtcagggatgccgcacataccggcgatttcctccggggaatcaaccccgcattcccgcaggacgggagcgggacagaggacccgcagcgcgaaactttccgcctccagctcatacaggcggtttcccgctccatgacgcgccagcacgggacggccaggggaaacatgacgcaagcggatatgccctatttcatgggtaacggtccagcggatttcattttgcggggcgctgtcattgtagcagacaacaaaggtttgcgccggttcgctccacagtacaaagccgtctttgtcatagtgcgcttgcagataggcggcgctttcctgaatccgcgccgcaaaagcagagtagctaaaaatcatccatccatttttaggcgggatggcgcaggggttgacgggaagtgcagatatgccttgttcaagcagaaaggccattgccgccgcgtcaaaaatggtttcgtcttacattccgtctttgttttcggcggcgggaaacgtgctgttaaagcgttccgcagcttcagcaaggccggaagtatcccctccgcgggcagcaaagggcaatgcgtgctttttgtcatatgccgcccgaaattccttatatgcgacttcatcgtcaagaatatccgacagcatatcttttatgcggtctttcaaaaattcgcgctgttcaggtttgagctttaggaatcctttcaagattaccgtctcgaaagcgtcaagcccgtattcgctggaaagctgggaaacaatcgttgaatcggattcaaggaacatttccccggtaccgttacgcagccaatcttcacgaacactatacttttcacaaatcaaaagtatagtacggtcagttacaccgcgttgtgcattttcaatttgcccaacagtattttgctttaatccgatatgattcccaaattccgcttgggtcaaacccaaagaggttcgaatctctttaattcgaccattaatttccattggtttcaccaccttatataaagcgtaacatctgtatatctctttgtcaatgtttttttcaaaataggattgacaattaaatctcaaagtgataatataatagttgcaaagagataaatggtgacgaaaaccataaaatcagagtgaacgcagagaaaaatgaaagccctcccaatgaaatgatgagggcattccaaaggcgagggcatcatgcagattgctacaatatttagtcacatggttgcggcaggaagccattcaaacaacgattgtggccataaatggttaaaagctgtgtaattttgtcatcaggaaaataacacatatctggattgcctgaacggttaacggaggtatgaccatctttttcaatagaaacagagatcgttaaaccaccaaattgggcgccgcgcggatatctcatacgttgcatttcagcattgtaatatattgcccaatcatattttcggagcaaatatgaatatacacgtcgctgagatatttgaaaattttcagcaaatttaaaaacatatatgctggggaaaacatcccaaagattggaaacattttcaatacaccatgcaattaaagttttaaggctcatgttgcgcttgaatccagatatagcacgctcatcaaggatttgtaaaatttgattccgtttaaacacttgtaaagcgatgcttggttcttccattatacgttcaagcaatatgcaacgggttagttggcgattagaatcactggccaaaacgggaaatttgatcgcctcatgatataaagattgataaaggaaatctttaattatcatttgttcagcatcgtttaagctttcaagttctgcaaccgcatcttcaagtgtaatttgcaggttcttgttgataccactttctgcatgctctttccacaagcccaattcaatagccaagcgatagatgtgcttacaaggtaatttgcgtaccgtaaaatctctgcaagtacacgtttttaaggtggtttcataggagataaaactggtgctggggaaaatggcggtcatttgattcttatcaatgctggctggcgttgttgccgacgattttgcagatgcaattcttttcgattgatcttttgtagaatgaatgttgtccagccaatccgcaaatgtcataaactaattcccccttcagtgttgataccatgttcaataaaaaatcaaatctacaaaatccctcctttctatacaaattataccatatagttaggaagggggcaaataaaaaagcaagaaaaaaccgccctagcgggcggcgaaagggggtgaacggtatggggcttatatggggcaatatggaatgggacacagacaggccagaggaattaaaagcgtttcttgaacgctataaacagcttggttttgacggagcgccgggggaggaatgccatttccttgtaaattgcgaattggcccgcagccggtacgggattactgaattgttcccaaacgaaaaattccgggccacgatttactatgacccggaatgcgaaaggttcattgtgacaagaaaagtgattcaggacgattgatgccggaggggggtgaacgggtggtccgcacaattttagcaatagccgctttaatccttgccggtatcgcttttggtttagcgggtacttgtgtaattgcgtttattgcattaagaaaacaggaaaaggggggtgaacagcatgacataccatacaaagacagcacggcacgcgccgatggaccacatcgaaaagcaggaagcagcgaaaaagattgccgtactcttggcggagagtacggcaacggtagatgatatgttcgatgttttccaactggtgcgggaatatctggttgtaacagcgagaatcccggagggtaaatcatacgggtttaccgttctcgaccaaacgcgagacgatgacgggatgggggacaagtagctccagcaggggccggaaagggggtgaacggtttggaggaaaaaaggaacgccgcgccggggagccagcccgacacggcacaggagaacacaatagagctttccgaaaacgaaattgcctgcattgaggcggaagccgcagaatgtgaacagctccaaaaggcttttgtatattccatcgaagcggatgcagaaaagcgtgaaatagcaattacattgccagcgggacaaaatcggcttgtgttgcctgaaaattgggcttacgcctttatcaaacaatttatgaatcaaatccgtgaatggcgcagtaatcaatagttgtatttgatggaatttttttgtgccgggtttgattcatccacattcgcaatgcaaagtgcatttcggaagaagataatacccggtatgcgtggacccggaaaacaaaatttcgctttttatctttcaacgttgttacaacgtcaggcgttggcatggaatccataaagacaccccctttcctcttttgattatagcatgagcgggagcgggtgaaaaggaagaatcagcggggggccggaaaccccgcagccagggggcaagcgtcgatgcggcgacggtaaacagggcattaggccgcaagcgtgggcgggaaatccgcccggttgccggaaagggggtgcaggaaatgagcgtatgcagagggtgcggcgctcctatcgactggataaagaccacagaggggcgcaacatgccgatagacccggagccggttttcatcattgagggcggcggaacggaccgtttcgtaaccgatgaaggggcggtagttttgggccgggtggcccgcccggatgaagaatccgccgccttgcccgtggggttcgtcccacactggaaaacatgccccaacgcggcggatttccggcgcaggcggtaggaaacaatttcggcggtggagcgggaccccgccgccaacgtgaaaggaagtgttacaggatggaagcgcaggttatgacaagcaagatgcaggaacgcaaagcggaagcggcggaatttctgattgatgcccgcagattgccgcctgaattgcgctggaagattcaggggatggttgagcttttcgacttcctgaatacggatgcggcaaaagcgcagatgcagggcaacaaaacggcggggtaaatccccgccgtgtagaaagggggcttatacatggctgaatttatacaggtaggttttaccgccacacgggaccccggaacaggtgaatttctgcccgccgtgccgctgttcattgaaaagacagcaagcgcggaacaggggcaggcggcgcttattcaggatttaggcaagctgtttgcccacaggatgcggcaatacatagaaggcggcgggcttgtcggggacgcagcggcggaatgggaaggatacgacacctgtgaacattacgaaaaaaggagcgtgaaaacatgaggcgaatcaaagtgatctacggagacggaacaaccgagcggtattgtgtaaacgtaagctatgcggaggctttggagttggcgcgcaggcaggcgcggaaacagggtacatacgtgcggggattcagttgtgtacggatatgacaaaaaaagccccgcaggactggcatcccgcgaggcgcataagaaaataaatcattttaattgtaacagaccgagaggatgttgtcaaatgaaaaaatacgagcttactgaggaaaccatcaacgtatttggcaagacgctgcaccgcattagggccacacgggacttttctaatgggcatgctggtgatttaggaggatttatagaggatgaactcaatttaagtcatgatggagatgcgtgggtctacggcaatgcgcgggtctacggcaatgcgcgggtctacggcaatgcgctggtctacggcaatgcgctggtctacggcaatgcgctggtcggcggcgatgcgcgggtctacggcaaggcattggtcggcggcaaggcattggtcggcggcaatgcgtgggtcgaaggcgatgcgtgggtcgaaggcgatgcgtgggtcgaaggcaatgcgtgggtcggcggcgatgcgcgggtcaaaggtaatgcgctagtcaaaggcacgcgggacatatattggatatcctgtattggttcgcgtgccggcacgacaacatttttccgcaatgcagacaacggcatcagcgtatcatgcggatgcttttatggtacaattgacgaatttgcagccgcggttacaaagacgcatggagacaatgagcacgcgcaggcataccgtcatgcgattgagattgcaaagctgagaatcaaattggaggatgccgaatcataaggcgcacaagatatgtggattgaaaaaggagcgagaaatcaaatgaatatcctagatatccttaacaagcacgcagcatggctccgaagcgaaccggagggcgtaaaggccgacctgaacctgggtatttcgtttggttccgctgtatcctgtctgattacatttatcgcgttaatgaaaaagcggaatcagggcagcggcagagaaaggaatatcaagagtttagtaaatacagactttgggaacatagccgcgcccttcaatttcagttattcattaaatcatcaacaagattctgaaaaatcggattaagcctgttcagcgtaaaaaaatgtttgttaatttctgatttccattcggaatcaatatcaaagtcaaggccatattcaagggcatttccagaaacgatgtagagcgcggcactaattgcaatagaaatcacgcggatttcatttgcagacaatgcggatttatgatttagaagtttttcagccgcgctattcgagtttgcaatattcaaaaggttttgggcgggtgtttcggtttctatttgggcaactaacggaagaacgcacacaatagcagatacatccgcgaaactgaaattgatattaccaagggaacgttttttgtttttcttcatgggcttgcctccttatatttacattatatctcaagtggacaacatgtgaaagagggaatttggcgcaagaggacaagcgtcgattcgacgacggtaaacagggcattaggccgcaagtgtgggcgggaatccgcccggttgccgggaggggggtgaacatcttggacaacaaaaagagcgccgcgccggggagccagcccgacacgatgcaagaatacgcagaacgaccttgcaagggggaatttgaacaatcagaatcccggtgaagcagttgtccaacggttgcgcgatatgtaccggcgcggaatccgttaaatatgggcaaagggaaaacgccccgtgcctgttctcctacaaacaggcgcggggcgttttaaggctttcgctgttcgccgctttataactaaaacagctacaatctataattaatattatagcaataaagcggcggaaagtcaatgaaaaccacggaaaaagggttgataaaatgccgcgaatgaagcgcgtaaccgtttcgggcgttgtgctggaacaggaaatatttaatgttgcccccaataccaaaaacttaaagggggccattccgaaaccgctaacagaacggatagcagaggaaaaagaaaaatataacttaaagcaagcattgaaacggtttatacggattgtaaaccacaatttcagccccgccgcctattacgttacaaatacctttgacgatgcacatttaccgcaggatttcaaagcggcgcggcgggcgctggataactatatacggcgcttgcaatatgcctttcccggtatggtagcggttgcggttatgggccggggcaagcgcagcgggcgcattcacattcattgcattatatccggggcggatgaaaaaacaatccgggaaaagtggacgcacggcaagataaagcgcatagagccgttgcggggacacaatttctataacggcgtagaccacgggcaggattacacagcccttgcaacctatcttttcaatcactggaccccggaacaagggagcgggaaacgctggaagcaaacaaagaccatccagcagccagaccggaaaaagccgacattcccgaaacgccgatatagcatagataaaccgccagttaccccgaaagggtacatgctggtagagaaacgcgaaagcgcccattacttaggcggttatctgcttttcaagtatgtaaaaatcccgccgccaggggcgggaacaaacgcaaaaatgctttgttaaaccggggacagcgttccccattatggccttgtaatataggtgcgttttacaacgaagggagaacatgtcaagaggattgcgcagatattcacagaatatttacatttttctctttgacagacacggcccccgcgggtgcgggggtgaatggccggggttggaaagtgcgtaaagttggaaaccccgttttcaacttttccacttttcaatgccggacagagggggacagccccccttccccgtcccccaaacctttcaaaagaatttttgaaagccatagccccgcagatgcaggttgttagcgttggaaagtgcgcaaagttggaaaccctgttttcaactttcccacttttcaatgctggatagaaattcaaaaggaggttgtccaggtgaaaaagaacagaaagaaaagaaaataccccacagcgtcacaggcgcggaaggccggatgggttatcaagcggttttgtgacaggcggacggcggacaatgcttgcgcgggttgtcctatccggcatatgtgtgaaacgccgccttatacatgggacagaaagcagggggattgaaaatgcagtatagcccgcagcaggcccgccagcaatggcaaaaccgggtaaacaatgcgcaggggcatattttcgaggatggcataaaagcagcgtgtgagatatatcgaaacagcaggcgggcaaaggtggacaagaccccggagccgttccgcgtgatggaaaagaacagggacgggacctttatgggccggtttaccgcccgcgccgcccctgattttcaagggacgcttcagggcgggcgatctatcgtctttgaggcgaaatataccacaaccgacaggctgaaaaaagccgttgtgaccgatacgcaggcggacgcactagaggaccatttacaaagcggagcggcggcgggggtatgtgcagggattcaagacagattttttcttgttccgtggacgatatggcgggaaatgaaagcgcattttgggcatgtgtccgtttcggcggcagaattggagccgttccgcgtgcgctttacgggtgcggtgctgtttctggactatgtacataccaactttgaaaaggtattcggggcagatattcaaaaatgacagaaaggggttttgatatgaggatttcgacaaaaagaacgccttaccgggtatgtctgttttgcggttcccatttggacgcgggggaagtttgcgattgcaaaaaggaacagcaggccgcgcttgtcgagcgggccggaaaagaaatcgttgcgaatggagcgggagccgatgaaaagacagcataaacggaaattgacggtcagggtaacgccgcagacagcctataaccttgaacgtttggcggcaatggcaggcgtaaaggggccggggcgcgttgttgataagctggtgcgggaaaagatgcttgcattgcacccgcagcaggaaaagcgaggcggttgcccgtgaatggtttaacgctgggaagcctgtttgatggaatcggcggctttcctcttgcggcgcagcggtgcgggattcggacactttgggccagtgagatagaaaccaactgcatagcggtaacaaagcggcattttccagaaatgcagcacttggggagcattacagagatagacggcggaaaaatcccgcccgtggatattatttcttttggttccccgtgtcaggatttatcggtagcgggcaagcaaagcgggcttgatggggagcgttccggcctgttccgtgaggctgtcaggataatttacgaaatgcgggaggcaacaaatggaatatatccaactttcattatttgggaaaacgtccccggagccttcggcagcaacaaaggcaaagattttcggaccgtccttgaagaaatcacaaaggccagaatttcaatgcctgatagcagaagatgggcaaaggccggaatggttagaattggcggggttgacgtcgcttggcggcagatggatgcccaatattggggaatcccccaacgtagaaaaagaatctttcttgtggcagattttagaggcagacgcgccgccgaaatactctttaagcccgaaagcctgcttaggtattctgaaacgggcgcaaaagcgaaaccgggaattgccgccgctattggaaacggtgctaaaatatcaagccgggatttcagatgcgccgccgatgccctgcaatgcacctatgaaacagcccacgcaagcgaggttataaggacgaacaagggcggggtatgtccaacgttacaagcccggatgggtacaggcggcaatcaaattccgcttgtgctggatttggaggacagcaaaaacatagtgcttgacgatggcggcgggaaatttgttgatgtgtacacaaacggcacttgcccaacgttgcgggcgcagacaaagggacatttgccttgcattatcggttgtcagcctatcaatatgcaggttgcgacacgtcataaccgattaggcgaaaataccgggctgggcattgcggaagatggggacccggcatatacattgcaggcggcgcacagtcacgcggtttttgcctgttatcccgtcaatgaagccgtgatacacgggaaagcaaacggtttcggaatcggtgaggatggggaccccgcccccacgttgaccggacgggaccggcacgcggtagcattctttgcaaaagcgcggtttgacctgttcacaagctccaaaacagcggcaacgattttagcaaccacaagcaagaatattgacggaattttactggaagcagaaaaattcaaactgtttatccggtttatcttgcggaaattgaccccgcttgaatgtgagcgcctgcaagagttccccgatgaatggaccaggtatagcgataccggggaggaaataaaggatacgccgcgatatgtggcgctgggcaacagtttagcggttccgtgtgccgagcgggttttccgcgggattatttcggcaatcggcggcgggccggggatagaatcgaggtaaaacagggtggaagattgtacgataaaatttcatccagcctttccgcaaatggtggcgaacatagcggaactggaggaagcgcggacacaacttcaaatggtgctggagcctgaaatattcgagcgggttcggcgaattatagaagcgcaggacgtgcggaagcgggccgcatattacggaactattgttgagtccgtgtgcgccgggaaagatttttcccgtgtggaatccatacaggacattgccgacatatatgcccgcttcattatcggacgggcgttttcggggtgaaatcatgtttgagctaaaccgactttataacgtggattgcatggagggcatgaaagagataccggactgctattttcagcttgccataattgacccgccctatggaatcggggaaagcgggaaaaagaataaatcccgcgggcgtttggcggtttcgcaggattacgccccctatttcggaggggatagggacgcgccgccgcctgaatacttcgcggaattacggcgggtttcccaaaatcaaattatattcggtgcaaaccattttatcagccggataccgtttgatagtgcgtgctggattgtatgggacaaggaaaacgggcaaacggactttgccgattgtgaattagcatggacaagtttcaagagcgccgcacggcttttccggttcaaatggcacggcatgtggcaaggggatatgcgaaacaaggaaatccgcatacacccaaaccaaaagccggtaaaactgtatgaatggattttgacccggtatgcgcagccaggggaccggatattagacacgcacgccggaagcgcaagctctttgattgcctgctataatatgggctttgactttttgggattcgagatagacaagggatattttgaaaaggcgcggcggcggctggaggatgtgcaagcgcagatgcgccttgaagattacgcggatatgaaggggcgttttctatgaataggtgtgaacggtgcggacaggccgtgccggatgggttgccggtatgcccggaatgcctgaaagcagcgggcgcgggcgaagcggaggttacggcggcggaggaattgcgggacatagcagcgattttgagcattgaggccgggatcgatgcgaacataaaagaggctttgcaggggattttgaatattgccgcaaggctggaaaggagcgtttcagatggcaaaaaagaagaaaaagcagcggcgcagcagaacgggggcggggccatggcgcagacagaggcccgccgccagggtgcggaataagaccgccccggcccccgtgccggtcaatcccctaatagcgcagatgcgcattataacggctttggagcgggtgcggaggaataccccggcaagcctgcaaacggccttgcagcaggcgcagcgcgtggcgcagaggatgcaggaacgagaagacgggcagagggaggcggacaggtgaaagcatttactatttatcaaccttatgcatacgcgattgtagcgggtttgaaaggctatgaaacccgcccgcggcgcacacatattcggggccgggtagcggttcacgcggcaaaactggatttgtggaaatcgggtattcttgaagctggaatagtgccgaaaatcgaaaaaatattgtcagaacaccaaaggctgggaaatcgtgccgcacatcttgattacggcgcggtgataggcacgattgaaattgtcgattgcgttcctgtggagtctcttataggtaagctgtccgagcgggaacggcttttaggcgactacacgccgggccggtatgcttggattctcaaaaatccggtactattcccctgtcctattcttgcccgcgggaaacaaggctggtgggaatgggacgaaaaggaggcaacaactaatgaaatgtaaaattaagcccgcagcaacgaaagagaggttgacaatggagaataaagatgagcagccgcgcggaacggtccgcaggtttatagagcaattcaaaatccgggactatgaagcggcccgcgccgccgtcgttggattgaccgccgcagggtttgacgttgatataaagccgtttaccccttataacgagcggaccagagagccgaaatcggaatttacctatcttgtgattacggtttatagaaggggatgaaatcgttgaggaatgagttaaacagatacccggtcacatacgacgaaatgagccttgaagccgcggcggttgaaatagagcaaatggcacggttaattcgcacggcgcccaccctgccgaatatcgggacatttgcagcctgcaaattttgtggacaacttatcagcgtttcggattcggtcattaatgaactggggagcgtagaagacgcaatagagtacgccacaacgcattgtgaatgtcaggaagccagaacctacacagatgaaaagcgcaggcgtaaacgggcggcacaggcccggcaatccgatttaatagaggccgaagaagcgattaataagcaattcgggcttgaaaccgaagatgcctgccccatttccgacgaagttcgtcaaatgctattggaggttacgacgatggtatacgatcacaaaattaaaggcttgacggtttcaataaatagcaaaacaaaggcgatcatttcgagaaatcaaaagggaaaacttctcattgaccgcaaagaaagcgataccagccgagcagaaatcggttgaaaggttggataaatccatatgaacataataaaaacgcagaggtttacgcaaagaacgccagcgggtgcaagtctgattcttgataatccgcagaacgatgttgaagcggcggcgcagatacaagaaaaattcagagcggctttaaatttacttgcggattttgaagatttgggttttaccccgcaggaaatgaaaacggacgtgaaagaggtttgcgccattctccacaaattcccggtttgtacggctgatattctgacaatcgcggagttttgcgcggaaacagctttgcgcaatgacagcttgcggcggttcctgcaattcaccttaaaagtgtaccacgaaagagtgtaatccccgaagcgggtgaaatctacataggaaggacggaatagcggtgaaaaccatatctattatcaacttgaaaggcggggttgcaaagactctttctgcggtcaatatggcgcacatcttggcggctgtccacaacaagcgggttttgcttgtggataacgacaagcagggcaacgcttctaaaatgtttggattgcacagctatgaaaaaaagagcgttgcggacattttgaccgaaaaggccccggacatgggggaaatcatagcgccaacacggtatgaaaatcttgaccttatccccgcaaatatgaatctgcttcgggcaaaccttgccgttatggtagataatacccggcagcgggaaacgcggtttaaaaaggcgttccgggccatttccggggattatgatttttgtatcattgacaacgcgccggatattaacatcagcacaataaacgcgctggttgcgtccgacgatgttttaataccgataaaaattgataaattcgcctttgacgggctggcagagcttcgggaacagatagacaacacgcgggaggacctaaaccccgccttgtgcttgcggggttgcttcgtgacctgctttcagcgcaacgacgtaaacgcgcagggcgaggaatggcttcatacacagcaggatttcccgattttcgcaacgcatatccgccgcacggaaaaggtggacgaaagcacatttgccgcggcccccataatcgagtattcgcgccggtgcggggccgctatggactatctgcaattcgtcaatgaatatttgggtatgttgtccgattcggacacaaacgcaaaggaggccgcgcagcgtgggtaaatttaatttgatggaccttttaaacacgcagcagagcgggcaggccgaaccgccgcaggtatccgagcgggaggaaacgcagccccggaaaccggcgtataaaatcatcgctttgagcgtgtttgaccttgtgccgtcagagggcaatttctattctattgccgaaatcgaaaagttgaagcgagatattgaattagcgggcggcgtaaagcagaatttaaccgttatcccattagacggtggaaaatataaggttttagcgggccaccgtcgccgccgcgcctgcttggagcttgtgcaagagggtaaaccggaatatgaatatgtcccttgcgggattgagccgcggcagcaggacaaggaaatgcaggaaatccgggaagaactcttgattatcacaaccaattcacagcgggaaaaaacggattgggacagggtgcaggaaacaaagcatttgcacgatgtattgcggcggtataaggcccgcggcgggaaattgccggggcggttgcgtgagattatcgcggacacgctgaacacgtccgaaacacagataggccggatgggggccattgctaaaaacctgataccggaatttcaagaggaaatgagggaaaagcggttagggatttcggcggcttatgagctttccgggatgccggaggaacagcaaagggccgctttggaggaataccgggcaaagggcagtttttcggtaaacgatgcaaagcagcggaaagaggcagaggggccgcagcgccgaaaggtgcgcacgctggatgaagcatggaaagagcgccagcagcaaagcggcgattcagacagcggagcgggacagcaggccccgccgcccgcaatctccccgcagcaggaacagcctgccgcccccgctccacaggaccggcccgcgccggaatcgtccgggcggcaggatggagaggaaagcgaaattgtcagcactataaaccggctgaatgatttgtgcgcctactgcatggacaagggggaacagtgcgacggttcaagagattggacccttgatgtaaaggccctgctttcggcaatcgaacgattagggggcgaaacagaatgaacggatatgcgcaggggttcaatatttccagtgaggaaatagcggttttcgtcagtgtggcaaggaaagcggcggacatgatgaatatttcaatttcggagcttttcgggaagttggagcgttacgcccgcgcaatggaggcaataggggcattttttgacagcatattaaatgccattcgggaaacggtggacgatttggcggacattatgcaggaaatagcggtttgggagttgctcccgccgctgtcaaagctggaaaggctatggagggcgcagcgccgccgcgcagagcgggaacgaatgcgggtattcctgaaatatcttgaatttctctttgttatcaggaaatataaaccacctaaaaaacgggagcgggtacaatgacattaaatcagcttgaacaataccgggatttatcaaaagaagtgaaaatgctggaacggcggatagcggaccttgaaagccgcccggaagtctttgtttctgattcggtggtgggttcgtcaccctgcattccctatcagccgcacacaatcgcaataaaggggtatggaaatcagtatcaggataaaataaacgccctgcaagtgaaatacatagcgcggaaacaacagctttgcaaggagctggaggaaatcgaagcctttattgagagcttgcaggatagccggttgcggcagattatagaatatcggtacgtaaagggtatgccgtggaatgtggttgcgaaaaacgtatacgggtatccaaacggaaataccgcacgcatggcggtaattagattttttgaaaaatcttgattttgtgcgttttgtgcgtttttgatgtggtatatttgtagtgtgaaagtgggccgaaaagaaatcggtccgcttttttgcgccttccgcgctgggcacaggaggcaaaacgggcaaataaacgaaaggggtggctatcttgggacgaccgcgggacccgcgcagggacgcggcaaaagattttttccttgcaagaaatgggcaagtaaccacaaaagagcttgcagaaaaagcgggcgtgccggatagcactatacgcaagtggaaaagccttgacggatggcaagcggcccttgacaagaagaaatcaaagcggcggcggggcggacagcccggaaacaaaaacgccgtgggagcgggtgcgcctatcggcaaccgcaacgctgaaacgcatggggcatatagtacggtccaccttaacgatttatccgaagaggaccggcaatatatagaatctatcggccttgacagtgcggagaacatgacgcgggaattgcagttattgaccgcaaaggaaagggacctcagacggcgtataaaggcgctggaggaggaaacggcggataccctgcatacggacaaggttatagaaatgcttacgccagggggcaagcaggacggccaacaggacagccgggaggacagcaacgcgggggaatccctgaaaacggcaatgcgcacggtgataaaatcaagcccctttgaccgggctatgaaactggaagcagagcttaacaaaatacacgggcgaattattaagctgatagacagcattaaaggctatgagatggaggcccgccgccttgaattggaggaacggcggttccggttcgcaaagcagcgcgcaacaggtgaatacagcatagacccggacacgggcgaaatagacgatacacaagaccatgacggcgaggaaggcccggacctatgaggcgcgggcaataggttctttcggcggctgggccgccttgcgggtacacgacgcccggcgtttttccagttgcgaaaaaattttgaacacttccgggaatgccggaaattttttaagggggtgcgtcaaagaaacagggcaaagggggcgggggcttgaaattatacgatacaaagcaggttgcgcggtttctggacattacagaacgccgggtgcgacagttgcgggaggaaggtattatttcggagttgcgccccggcctgtatgacctgatagacgcaaaccacaggtatataaactatttgcgtaaccgaaacccggacagcgcagaacgcattgactacaacgcggagcgggcaaagctggtaaaggcaaagcgggaaaatgaagaatatgatttgcgcctgaaacggcgggaattgcacacttcggaggaaatcgagcgggtaatagaaaccctgcttatcaatttccgcagccgcctttcttctatcccgtccaaacttgcgccggtattgagcaaaaagcgggacacggcggaaatagcaagcctgatcaagtaccagatagacgaagccttgacggagctttcggaatttgagggaatggaggaagccgcagatgatgaacatcaggccggaaacgcgggaactgttcaaaaagatatttaaggttttagcgccgcccccgaacatgacgctttcagagtgggcggacaaataccgttatctttccccggaggcggcggcgcgtccggggcggtggcatacagagaataccccgtatttgcgggaaatcatggacgcgatttcagacacagcggttaaaaaggttgtcgctatgctgggggcgcagcttggaaagacagaagggttaatcttaaatacgataggttactatatgcactttgacccgtcccccattctggtaatgcagcccacaatagacctgggcgaaaccttttcaaaggaccgtttaacccctatgttgcgggatacccctgtattgcggggaaaagtcaacgataaaagccgcagcagcgggaacacgatattaaaaaagcactttccgggcgggcatatcgctattgtgggggccaattcccctattggcttgcgcagccgtccgattcggatacttcttgcggacgaaatagacggataccccgccagtgccggggaggatggggacccgctctatcttgtcagcaaacgaattgcaaccttttggaacaaaaaggaagtccatgtgagtacgccaatattgaaaggcacatcaaaaattgaacgggaatataacaacagcacaatggaagaatggtgcgtgccttgcccggtttgcggtgagctgcaacccctgcaatggaaacatgtcctatttgacgcaaataatcttgatgaaatttcgtattcatgcgagaaatgcggttgcgtttccagtgaagcggaatggaaagagcattttacagagggaaaatacattgcggcacacccggagcgggaaacacggggttttcatgtaaattcccttgcgtcaatgttcatggactggaaaaagattgtgcaggattttcttacggcgaatgaggaaaagaaaaagggaaatatcgaaacgctgaaggcatggacaaacctaaacatggcggaaacgtgggcggacggcggagaacaggtagacgaagaagccctgttcaaacgccgggaaaagtataattgcgaggttcccgccgatgtgctttatttgaccgcgggcgttgatacgcaggatgatagattggaagcggaagttgtcggatggggcgagggcgcggaaagctggggaatccggtatgcggttttctatggcgataccaaacttcaaaaagtatgggacgatttggacgcattcttattgcagacattcgagcgggcggacggcgcaaagatgaaaattatttgcacctgcattgacagcggcggacacagggcgaataacgtctataaattctgtaaagcccgcagcgcccgccgcgtatatgctattcgcggacagggcggggacgttccctatatcaagcggcccacaaagaacaaccgcgaacaggcgatattatttactttgggcgtggacgtgggaaaatcaatcctgtatgaccgtctgaaagtggagccgccagaggatgaaaccagcgaaacggaaagtatgccggggtactgccatttcccgcggggccgggaccggggctatacacgggaatatttccggggattgaccgcagaacatagggttttgacctataaaaagggcgttccggtgtacgaatggcgtattaaggacgcggcccacaaacgaaatgaggcgttagacgtgcggaattacgcaacggcggcgcttgaaatcagcaatgtaaccctaaaaaagctagacaatgccggggccgcagctccaaaacggcgggcgggaaggcggcggcgttcatcgggaggggtgatttagtggcacggaaagagaaaacagagcttgaaatagcgcgggagcattacaaaatgtggctggaggctgaagaagaaatatcgttgaatcagtcttacgcaatcggaagccagtcgttgacgcgggccgacttgtcaaaagttgcggaacgtattgactattggcggggccgcgttgaaaagctggagaatttggaaaagcacaagggccgcaatcgtgtttaccgggttgtcccccgcgacttgtaaaggaggccgcacggcttgaacatcttagacaaagcaatatcaaccgttgcgccacaatgggggctaaaacgtataggcgcaaggaaaaagctatccattctaaattcaacaggttatgggaattacggcgcgtcgcatacaaaaaaatccttactggggtggatatttggcggaggttcacacaaggaggacatagaggaccatttacccacgttgcggcagcggtcccgtgatttgtatatgggcgttcctttggcttgtggagcattaaaaacgtgtcggacaaatgttgtcggggctgggttaaagctcaaaagtcaaattgactttgaatttttgggtatttcggaggacgaagcgcgggaactggaacgaaaaatagaacgggaattttcgttgtgggccgattccacggcgtgcgatatagagcggctggacaatttttgcgagcttcagcagcttgcatttttaaattggcttatgtccggcgacgtgcttgtaaccttgccgaccacaaagcggcccggtatgccgtatgatttgcgtatccgtttaattgaggcggacaggttaagcaaccccatggggaatacagacccgcatataatcggcggcgttgaggtaaacgacgcgggggaagttgtcgcgtatcatatttcaacccaccacccgctttcgtggcagtattcagaaacaaaatggacgcgggtggaggcatacggggccaaaaccgggcggcggaatgtcctgcacattatgaaccgtgaacggatagggcagcggcgcggcgcacccttccttgcgccggttattgaggcgttaaaacagttaggccggtacacggacgcggaattggtcgccgcggttgtgtccgggctttttgcggtattcattgaaaagaaaggaacttcggaggatacgccgataggagccgtcataccggaaaatcagcaggtggaccgggacgacgaaaacagcattgaacttgcgcccggtgcggttttcgatttaaacgagggtgaggaagcgaaatccgtaacccccggcaggccaaacgccgcctttgacccatttgtaaccgccatatgccgacagataggggcggcgctggaaatcccctatgaaatcctgctaaaatgtttcaattccagctttacggcaagccgcggcgcgcttttggagttttggaaaatggtaaaaatgtaccgcgcgtggcttgcaaatgatttttgccagcccatatttgaggaatttttatctgaggccgtagcgaaaggccgcatttccgcccccggattctttgcagatccgcttatacggcgggcatattgcggagcggaatggaacggccccgcgcaaggacttttgaatcccgtgcaggaggttgaggcggcggcaaagcgcgttgaaaactgcttttccacgggtgaacgggaggccgcagaaatgaacggttccgatttttaccggaacgcgcagcagcgcaagcaggaaaaaaagataatgaaagaggtggagagcattggcgacacaaataccggccccgcgcaacggtccgccccggcccccggtgcggagcagcagccagcagaaaagtaaaaagttttgggattttgtttccgcgggtgagaatcagcccgcggaacttatcctatatggggatattgcaagcgaaagctggtggggggatgaaatcacgccccggcagtttagcgacgaattgcaagccctgggcagcgtttcggaaatcgttgtgcggattaacagcggcggcggggacgtgttcgccgcctttgcgatttacagccgcttaaaggaccacccggcgcatatcacggtgaaggttgacgggtgggccggaagcgccgcaacgattattgcaatggcgggcgataccgtaaagatacccgcagcggctaatttcatggtgcataacccgtcaatgggcgttttgggatactatcaggcgcaggatttccgcagctttgcggacgaatgcgacacgataaaggacagcattgtaaacgcctatgccctgaaaacaggaaaagacaaaagcgaaattgccgcgattatgagcgcggcaacatggtacacaggggaaacagcggtacaaaacggtttttgtgatgaattgatgtttgaggaaatccaaactgaggccacaaacgcccataaaatcattgtaaattccgttgaaatggacctttcaacgctccagaatgtaccgcaggcattgttaaacagcaggccgcacgggagcggtaactgtttgaatcataccgcacaaacagcacaaggggcgggaacgccccaaaatcaaaaggagagtgaagaaactatgccggaaattaagacagtggacgaactgaaagcggcctaccccgatttcacaaaggcaatcgaggatgccgcagccgcagccgcgcaggatgcggagcgcaagcggattcgggacattgagggcgtggcaatcgcgggatatgaggatattatcagggccgcaaaatttgaaaagcccacttccgccgcagacgttgcccttgcaatcgtcaaccgccagaaagagcagggtggaaaatacttgaataatcgcgccgctgatgtgacgggcagcggggtaaacaatgtgggcgcagaggggcaggaaggggccgcagggagcgggccggacccgttcacggaagccattgaccgccttttccccaaaacgaaataaggaggatttctcatgtacgaaatcaaaaccggagaatatacccccgacaattttttccgcggctttttccccgccgttcctgaacacgggacggtaaaggatggtgcgacggtgcgcaagtatgcgccggtagcggaaacggcggacggaatcgaggaagtcacggcggaaacgctggataagctggcaggcattgcggcagacgtgccggatgtcgaggggaacgtcgtatactacatgaccggcgatttcaacgcggaggcgatagttttgccggacggcgtgacccttgacgcgctgaaacccgcttgccgtaaactttccatctttttgaagtaaaggagtgtataaaagtatgccttacgaagtttctgtttttgacccccgcacaatgggcaagctgatttcccgtatgcccccggtgcgaacctttttccgcgacacgtttttcaggcacacggaaaccttccctacaaaaagcgttgatgtggatttcaaaaagggcaaccgcgctcttgccccgtttgtacatcccaggatgccgggaaaaacagtccctaatcggggatatacgacaaagacatataccccgcccatgctgttcccggacaaggtaacaaccgtggatgacctcttgacccggatggcgggcgaaaacccgtacagcggcagaaccccggcagaccgcgccgttgagaaattggcgcgggatttttcggagcttgacgaaatgattacccgccgcgaagaatggatgtgcgcacaggctctttataccggcgttatcccgattattggcgaaggaatcaatgaggaaattaatttcaattttaccaacgcagaaaccatcgcagatgcggcgaaaaagtggagtaaggacacggcggaccccattgcagacctgaaacgttggcggaaaaccgtacagaaaaacggctttgtcaactgcaatatctgcattatggcggatgatgtggcggaggcgttcacgcgcaacgcaaaggttatgaaaatgcttgataccgaaaaatacgatattgcggttatcaagccccgtgagcttttgaacggcacaacctatatcgggaccattaacgggatggggttggacatttatacatatacggaatggttccttgacgattggacagacccggacgcgccggaggaaaagccccttgtcccggacggaacggttttgttggcttccacagcggcaatgtattcccggtattatggcgcggtaacgctgggcaataagaaaacgaataatttcgcaacggtggaaggtgtgcgcgttcccaaaagctggatggaatacaacccggaccgccgctttattcagttgttcagccgcccgcttcccgtcccccatgaggttgattcgtggtttgtcgcaaaggtgctttaaggctatgcggcggagtttcaaagcgcagcttgaccgggaccggaaacgggtattccacaatagccgggaatttgcggagataagagaaatcgagtacgacggggattattataaaattcccgtcgtacttgactatgaggccgcaaaagaccggaaaaagccttcgacagactatgcagagggcattttccttgttgatctggtagtttatatcgaccttgacgatataaaccggataccgcgcaaaggaaatcagattgccatagacggggatttgtacaacattgtgacggtagaaaaccgacgcggggaaattgttctgaatttagaggcgtttacagagtttgggggcgtttaggaatggtaggaatcacaagcgaacagatagaacgggtggaatccattcttaacggggtgcagcgcgggccggaaaaggttttctttaacgtgattaaccgcgcattggatacggtgcggacggcgtcaggccgtcagatacgggaggtttacgcaatcaagcaaaaggatttgcgggcggaaagcaatatcaagctgaaaaaggccagtcaaaccgatttagcgggcgaaattgcttttgccggttgtaaaatccccctgtatcggttcaacgtaacccccaaacagcccgcgcaaggcgtgcgggtgaaagccgccgttctgaaatccagcgcccaaacggaatttgaacacgcttttatagcgcggatgcaaagcaggcatgtcggtatgttcgagcgggcaaccgcaaagcatttgcccattgatgaatttaccgggccgtccgcagcgcatatggcggggaacagcgttgttctggaacaggtggaacaggcggcgcaggaaaccatagacaagcggatagaccacgaaatagacaggattctttccggatatggagggaaatcatgacaccttttgtattgcttgatgaactgaaaaagtttgtcgaggcacaaacaaaggatttgcttttgccggtgcggttggagcggaacagccagggaccgaaagaacgcgcccccgaagtgtttgttatgcgcctgaaaaagagcgcggacaaaacaaacaaggttccgtatgttctgcttcagtttatcaagagcgaggaccggcaggagccagggcagcgggtagaatgtgtaagttgggtgcggattatcgcggcaacgtatgccgaaagcgaggatgaaggggcgctgtccgtgctgaatgttttaacgcggattcggcttgctttgttgcgggccggtattgtgggaaagcagtttgtcctttgcccgccccttgaaatgattgtatacccggacagcacggccccgtactatctcggagaaatgttctcggtttggagcatgccgaaaatggaaagcgaggtaaatttatggcaggtataaaaaagagcgtacaggacgaacagaacgccgcacggcaggccgcagcggacgggacaggaaaagataccgccgcaatgggagcgcccgccagcgggccgcagaacggcgcacaggacacgccagcggcggagtatacgaaattcgtttatgtggggccgccccttccccgcggcacgctgaatcataacgccgtttttgatgggacgatgcaggaaatcacggaatacctttccgaagtgctgaaggactatccgcaggtgaagcggctgattgttccggttcacaggctgggagaggccagcgcgaaagcgcaaacgcccggaaatatcctgcataaatactatatcgatattgtttcggcggtcagcagccggaaaaaggaggggtaaaacgtgggtattggctatgaacacggtataacaagcgaacagattgaaacttcggtttccacgccgcgcacggcgggttccggcattgcctttgttgtgggtacggccccggcgcatacggtgggcggcgcggtcaacgcgcctgttatggcgctgaattacaaagaggccgttgccgcgctgggatatagcgaaaactggaagaattacacgctttgtgaagtcatgcattccagtttccagctttacggggtttcgccggtatttttcgtgaatgtactggatacggaaaagcacaaaaagacggttgaagcggcggaatatgaaatcattgaccggaaagcgtctttgccgttggaggcaatcgcggagagcgtcgaggtaacggacgaaaccggcacgacgacgtacaaagcgggcgaagattacgggcttttgtacgacggggaaaaccttatgctggagcttttggacggcggcgctatcactgaatccgtggggaaacttaaaattgcgtttgacgcggtagacccgtcgaaagtgtctgattctgacattatcggcgggttcaatgttgctacaaagaaaacaaccggctttgaacttgtggacacggtctttgcaaaatatggcattgcgccggatttacttttgtgtcccggatggtcccacaagccggaagtcgccgcgattatgaccgcaaaggcagaaaatatcaacggagttttcgaagggaaggccctgattgacattgacgcggcagcagtcaggcactatacggacgcaccggaatggaaaaaggagcagaatattttttcaaagtatcagattcttttctatcccatggtaaaactgggcgaaaggctgtttcatctttctacgcaggcggcggggcttatggcgaaggtggacacagacaacgggggatgtccatgcgaaagcgcgtccaataaaaatttgcaggtcgatagtgcggttgtggatgatggcgcagcgggcggggaaatacttcttgacccgcagcaggcaaactatttgaacagtcagggcattgtaaccgccctgaatttcatgggcagctttgtcctttggggcaatgaaagcgcctgtttccccgcgagcacggacataaaggattatttctatcccgtaagccgcatgttcgggtgggtgtcgaataccatcgtgcttaccttttggggcaagctggacaagcggcttaaccgccgcctgattgataacatttgcgacacaatgaacatttggcttaacgggttgaccgccgaggaaaagattttaggcgggcgggttgagtttcgagaggatgaaaacccggatacatctttgatggcgggcaaagcaaccttccatgtgttccttaccccgtgcagccccgccaaacatttgcacttcattctggagtattcagccgagtatttagcggcattgttttagtaaaggagggaacagacattgaaagttgacaacggaacactgaatttccgggtgtatgaagatgcagtcgtattctatggcatggcggaggttgctttgccggaagtgagcatgcttgcggaggaagtcaagggcggcggaattgccggcgctttcagcggcgtttttataggccatacggaagcaatgtccacaaccttgaatttccgcagcgttaccgcagacgttacccggttgatggagccgcgcaaccatcagattcagcttttggcttcacagcagatgtgggattcggcggcgggtgagtttaaggaagttgcggtcaaacaccttttgaccgggacaccatccaagtatagcccaggcaaattggcccccgcttcccccacggaaaccacgattgaacttgcggtgacatactttgcaacgttcattgatggggtaaagaaaatggagattgacccgattaactgcattttctttatgaacggcaaagattggcttgcacagacccggcgcaatatcggaatgtaacggataggaggaaaaaacatgaatgaggaaatgaaaaccggtgcgaacgcaacagagcttgcgcccggtgcggttgtggcattggagccggaaaagcccgctttgggttccagcgttgcggggctggatggggcaagcggcgaatatgtccataaattcaaaaagccgtttgaatatgagggaaagcggtatgaaaccctttccttcaattttaaccggctggtaggccgggatatgacggcaatcgagcgggaaatgcaaatgagcggcgaaaccgcctacaccccggaaacgtcccacgcctatcaatgcaggcttgcggcacgggcagcggggattatgccggacgtgctggaggctatgcccctgggcgattttaaccggattaccaacagttgccggaattttttattaagtaccgggtactaaaccagaatccggcccggtggttcatatcgcaaagcgtaaaacttgcccggtacacaaacacgccggttccgttctatcttgatatgacgattgcggaattaaatctttggatttatgaatgcaatttgatgatcgaggaagaaaaccggcgcataaaagcgcagcaaagacagacctaaacggacaaccgcccccggcatgggggcggttgtcttttgccataagggggtgaggatttggcggcgggggcgcagaaagtattttctttggtttttcaaattcaagcagccgttggcagtaactttaacagctccttcacaagcgcccaaaatgcggcgcggaaactgcaaaatgagctttccggtattaacgccctgcaaagcaagataaacggataccaaaagcaggcggaggtaatcgaaaaaagcaaggaaaaacttgcggcgttgacagaggaacaagcgcgtttgcggcaggccatgagccaaacagagcagccttccgaggctttgcggcgtgcctatgagcggaatgcccgccaaattgaacagaccaacgcaagcattcagaatcagcagcagcggcttgatgaattgggaaatgagttgcgggatgcgggggtagatacagaccggctaacagaggaaaacgacaggttagcggacagttacaaccgcgtgcggcagaatcaggaacggcttgcacaccttgcggacgcgcagcagaaaaacgccgccgcaatctcaaagacaaaggcgcagcttgccggaaccatcggcgtaatttcggcggtgggcgcggcgatttacgcggggccggtgcagcaatccataaagtttcaatcctctatggcaaaggttggaacgattgcggacacggcggcgcttcccttgaatgcacttcaaaaggatatagtcagcctttcaaacgaaatcggggtaaacgcaaacgacattgccgaagatgtgtacaacgcgatttcggcgggccaaaagaccgaagatgcggttggttttgtcggtcaggcggtgaaattggcaaagggcggctttgcggaaaccggacaggcgctggacgttatgacgacgatattaaacgcttacggcaaggaatccagcgaggccggagcggttgccgatatgctgatacagacgcagaataaaggtaaagtgaccgttgcggaattgtccagcgtcatgggtaaaatcattcctactgcaaacgcgaataacgttgcgttggagcagctatgcgccggatatgccattatgacggcaagaggcattgccgcagcggaaacgaccacttacatgaatagtatgctgaatgagctgggcaagaccggcacaacagcagacaaaaccttacgtgcagcggcaggcggcagtttcaaggacttaatggcgcagggtatgagcgttgcggaagtcctggacattttgcaggcagaggccacaaagggcggaaagagccttgcggatatgttcggcagcgcagaggccggaaaagcggcgcttaccttgatggcggacggcgtagacggctttaatttgcaggttgccggaatgctggacagcacaggcgcggcggaatccgcatttaagaaaatgtcggaaaccacggaagaaaagattgcaaaggcgaaaaacgccttaaacaaccttgctattgtgttgggggatacctttttgccctatgtgacaacaggggcgcaaaaggtgtctgaattggttataaaattcagcgcgtgggcgcaggaaaacccggaattattaagcacaatcgtaaaaattggcgcaggaatagcggcgttcgccgtgggcggaaaagccgcaaaattaggatttttagagataaaaggcggcattttgtccgttgcaactgtttttacaaagctaaaagcaatgggcggtattcaaggcgttttaggcaatttaggcggtatcaagggtatttttagcggtattggcgggaaactcttacctatagccgggattgcaacggggattgcggttgcaattaaattgatttccggcaatcttgacgaagtacgcggttttattaaaagaacctttggcgatactggattagccatatttgacaaggtttggggcgtaataaccaacattgggaacgcaatcaagggagttttcagcggcgggaatcttaccggcgcacggaatttctttcaaaatacgttcggtgaagcgggcgttgcagcttttgacgcaatgataggcgttgtagagcagctaaaggcggttttgccggggcttctggaccagttgggacaaatggcaatggcgattttccctgtcattatgaacgcggtgagcgccctgttgcctgcaatcatgcagattgtcggaagcctgcttccgccgcttgtttcccttatcggtgagctattgccggttatcatgcaaatagcaagcgcaattttgccggttataacgcagcttatccagaccatagcgccagtcattacagacatcgtaaacgcggtccttccggtgctgattgaccttttcaatacctttatgccgataattacccagcttgtgcaagcggttctgccagtcctgcaacaaattttgcaggcgttgacccccgtaataacaattttggcggaaatattcggcggggttttaggggcggctatcaacagtgtttctcaaataatcagcgggttaatgtccgttatcggcggcttaatcaactttataacgggtgtgttcactggaaattgggcgcaggcatgggaaggcgtcaagaacattttcaaaggcattttcgacacgctggccggaattgtgaaggcccccatcaatgccattatcggaatcataaacggtgcaatcagcgggataaacaaggtgggctttgatattcctgattgggttccatttgtcggcgggaaacagtttagaatcaatatcccgcaaatacctatgcttgcaaagggttcccgcaacgcgccggatactttcatagcgggcgaacgggggccggagcttatcacgaacggcaagggccggacggtgttcacggccttacagacggaacgcattatgagcaatgcgggcgcggcacagcagggggcgcagcaggtaattataacccttgcgcccgcgttgatagcggcgcttgccgccgcccccgccgtgagtacggtacacagcgcggcggttgtgccgcagatgcaggcggcggaattgcaggccgcgccggtccagcagggcgggacggtgttccgctttgaaagcgccccggttttcaacgtgaacgggggggaccaggaggaaatgcggcagatgttcgaggaataccacgacaggacattacaggacgtggaggaaatgcagcggcagaaagaagcggacgaaaggcggggacggtatgagtaacacatataagaccatatctggcgatatgtgggattcaatcgcgtttaaggctttgggtggtgaaagatataccgacaggctgataaaggcgaatttgcagtaccgggaaaccgtcattttccctgctggggtggtattggagcttccggcgatagagccggaaatctccgccgccttgccgccctggaaggaggcaggcaatgagtagcaaagacacagcacgccgaacggaaattattatctattttgcgggggtagatatatcgcagagtatccgcccgtatctgcttaccatgacgtataccgacaatgaggaggaccgaacagatgatttgcagataactcttgacgatagggacagaacatgggtgcggtggttaagcacaccggcgcccacaatagcagaagattcaagcggctggaaggttggcgatacagtaattgccaacgggaggccgcaatattccagttatggcgggcagccgggagtggaacttacaaattatcaagggaaaatcacgcttttgaacttgaaagacggcgttccctatccgattcatgtagatcaaaagggctggtttgcagaaagtcaggtgcaaaaagataatgagataccgcaggcagcgcaggaaggcgggagcgcaaagggcgcaaaaatccgcgctttcatcatacaaaagaattggaacgggaccggcaaagaccggaaattagattgcggggttttcgagcttgacagtatcgacttcagcggcccgcccggaaaggtgagcatgaaggcaacgtctatcccctattcgtccacaatgcgaatgcagataaaaaccaaggcatgggaaaacgtaaaattgtccacgattgcaaacgatttagcggggcaaaacgggatgcaatgtatgtatgaatcttcctatgacccgctttatacacgcaaagagcaggtaaagaaaacggaccttgtttttctgcaagaactttgcaaaagcgcggggatttcgttaaaagtcacgtcaaataccattgtgctgtttgacgcggcggaatatgagcagaaaccgcccgtgctgactatcagttatggcaattcggatataacacgtgccagcttcgggaccagctacacggatacggcctattccagttgccatgtcgcctatgaggacccgcagacgggccaaaagatagagggcgaatatcagcagcccggcgagggcagcggacaggttttggaggtaaacgaacgggtaacgagcgccgccgaagcaaaggagcttgcgaaaaaacggttgcgtcagaaaaacaagggggaagtcaaagcggaatttacccttgtggggaatgtcgggcttgtagccggtttaacggtccaggtggaggggtatggatttttcgacgggaaatacatcattgaaaccgcgacgcataaccccacgggcgggtattctgttggactgaaactgcgccgtgtactggaggggtattgatggcggaatctgaaattatggaagcaaaaaagcaaattgctgttttgaaagagattgtccgcgttggcacggtatcttcggtggatgttgagcagcgcacagcgaaagttatcatctatgacaagataaaagaatttgtttccgggccgttgaaagtattgcaaaatcagccccttattaccgtggaaaaatgggttgacggaacgaaatgggagtatgacgcaaaatacgcttctgttgaccgctctttaggtttaggcgagagctacacgaaagcggccccggacgtaattaagaacgaaacgccgggcggggaaatcaaatacgccggtgaaatccgggagcacaaacagacaatcacggtttacccgtggcttccttatatcgggcagctcgttatatgcctctatttaccgaacggggagggagacggttttgtattgggagggctttagaagatgtcggttatcggaacatggggcgatattgcattcagcgtttcgcggggacaggtaaaaacgtttaacgcgctgaaatgggacacttctataaaatacgcgacccacgaccggcatttaaaaaccgctcttttggagtataccggcagggatgcggacagtatttcattttccatgttcttttctataatgctgggcgttgacccgtcaaacgaaatccgaaaacttgacagcgcggcgaaaaatggcagggttgcacgtttgattgttgggggaaaatcatacgggaaaatggtatgcacaaaggtttcaaaggatttggagcggttcgaccatcgaggccgtgtgattagcgcgaaagtgagcgtttcactaaaagagtatgcagggaggtaaaagcggtgtacgctgtgaaagcctatatgggcagtaagataaaccttgcgcctgaaacgcgggaggaagaagttttacagaatctttccattctgctttccacgccgaaatttactgtcccgcttgatagggatttcgggctttctcagcggttcgtagataagcctttgccggtggcggaatccctgtttcgggcggaaattttggacgcgatagaaaaatacgagccgcgggttgaagtggaaaacgtgacctttgaacaaggggacgcaccggggatgctaataccgcgggtggaggtgaatatacttaacgatgaagattagagaatatcccgacattcactttgtcgatacggatacggaaacccttgtaacggcgctgataacatcgtatgaaaaattcacgggccggacgctgtacccggcggacccggcgcgcctgtttatcctttgggtggcggatatcatcattcaagagcgggtaaacatcgacttttcggcacggcagaacgtcccgcgttatgcagagggcaaatatttagactccctcgcagaactgttcaaagatacatacaggctggaaccggaaaaggcgaaaaccaccttgcgttatacactgtccatcaaacttgaatccgcaaccgtcatcccagcgggggcacgcgccacatcggacggcaacattgtgtttgccacactaaacgatctgatcattccggcaggccaattgtccggcgacgtggcagcggaatgtacgcagacaggagaaatcgggaacggttttgttccgggacagatcaaacaggcggttgacgtgttcccctattttcaaagcgtgtcgaacacaacgaaaagtgcaggcggtgcggataaagagagcgacgcggccttttatgagcggctgcgtaagagcgtggaaaccttttccacggcgggaccgatgggcggatatgagtattttgcaaaatccgcgtcggccttgatcgtagacgtaaaggcaacgtcaccggagccgggagaagtggatgtaaggattctgctggcaggcggagaactgccagaggaagaaatcttgaaagcggtttcggaaatcctgaacgccgaaaaagtgcgcccgctgaccgatcacgtcacggtttccgccccggaaatcgtgccttatgacattgattttacctactggacacaagagggcggtacgataagcggcgaaacggtggcggaaaatatcgcggcggcggtgcaggcgttcaaggaatggcaaggcgcaaagatggggcgggacgtgaacccgtcttatttgacttccctgcttatgcaggcaggggcaaagcgcgtcaaggtgcgttctcccgttgataccatcgttcccgaaaacgccgttgcgctaattgaagaaacggcggttgtgtatggagggacggagagtgaataacaacgatatttattctatcgacttcacacgttcgcttcccccggcgttgaaaaatgacccgaaaatgattgcgctggcgcagaccgtagcggagcaattacaggtcaactcgcgactgataaaccgaaatatcatctattcccgtatcgacgaactggacgaagaaacccttgatgttctagcccatgacctccatgtggattggtatgattgctcctggccgataaatataaagaaaaagattatcagagacaatgtcaaagtgcatcggtatatggggacgccttacgctgttaaaactgcggtgggtgctgtattttccaattcacaaattaaagaatggtttgagtatggcgggaatccgtattactttaaaatactgttgtacgatcaggatatgcccgtttccattccggccaaagaaatcagaaaggccgttgaattctataagtccctgcgttcccacctggaaaaaatcacgatgatcatcgaagccgcggcgcggctcgaaatcggattttcgtggcggcttgcaatgcggacccgtttaagcgtatgggggatgcatgaaatccggctgaacggcagccgcggcttaaacggcgagtggatattgtccagcgtttgggaccggggcgcgcattttgaggaatttgctttgcatcaccgaaaacggacgccgctccagatgacggcatatatgaccatcatgcaaagagccggatttgagcagcgggacataccgaaattgtcccgttttgccgtgcggacccgaaacaatgtatacagcccgcaaacgatgatgttggacggttcccacaggctggacggcggggggcggcttgggactgtgtttatacgtggcggcgtattgcgggcgtgcgcttttcgggcgtctgcaaatgccagcccgtgtattaaggccggcctcatccgaaacaacatgtggcgtctggacggttcccgcagtcttgacggtgagcagctgttgaacgcggatatcattacaagcgatctttaaatcatggaaggaagggattattttggcggagaaaaacagcatcattacaaaagcgcggcggattgcgctggccaaattaacggccggcgtaattgacacaatcccgccggtcgcctttatcgccctgggggacggcggggtaaacgaaagcggggagcctattgccccggatgtggaacaggaggctttgacgcatgaggtttgccggtatgcggtacagaagcctgttgccttcccggtggagacaacggcgcgattcgtaattgttatcccggaggatgaacaagccaaaacaaaattttccgaaatggggttggtcgatacagaggggaattttgttgcaattaaaacaatgtatgtgaagcagaaggatgacgatgtggagttttcctttaccttcgatatggaattttaattggaggggatatttatggcagaggtacataattcctggcaggatacaatgggcgaaccttatccgattccggagaatccagtttatgacgcatccaatattctaagaccgacgaccatgacaccggcccatgcagacatgtttaacgagatattttcccgcctgatcgtcaatactgcggcagtcaagagcattgctgacagcaaagcaggcactgacaccgctgcgtctgatcaggatggattgatgtcgaaggaagataaaaccgccctcgatcaagcgttgctgaatattgccgccttaagcgggattttgggcgacggcacggcaggcggcgatttacaggggagctatccaaacccggcaatcaatcccgcaaagctgacaggtatcaaacctgcgtttgcgcaggcagcggcccgcgcgaatattaccaatggcgataccctggcaattatcctgggtaagatcgccaggatgtatgcagacttaaaagccgtggcatggagcggcagctacgccgatttgacaaacaaaccgtccagctttacgcccgcggcccatacccatgacgaccgctatttcacggagacggagataacaacaaagctgaacgcaaagtccgatacgacccatacgcatacggcggcgcaggtaggcgcggctgcggtgtccagcggtacatggacgccaaatctcaacgacgcatacaatgcctgctttaccaacacaaatgcaagcggcgtctggtaccgggccggaaatatcgcactgttttacttccagacccaattaacccgaaaatccagcaacagcgcaaacatgtattgtacgacgccgtttgccggccatacgttcggagaagtgattctgcgcgggccgaccagcccaacgcttagaaagaattgggtattggcaaacacaaatacaaattccacctggatgcttatacccggaggcgcgtttgcgacagaatcacagatgtcggtaggcacggacttttggtattacgggcatggcacagttttgctttaagggggcagtatcatggataaaacaacgaaaaaaacatatgacggcctgtgctctgacttcgtttttattgagacacaggattttgaggatggcacaccaaccaccttgccgcaccgccagatgttttacaacacggaatcaggacgagcaatgctggcggaagcagcgccggagctgctggatgaaattttagcggtatggggcgatcaaccggcggccatggacggcgcggaaatattggagccttttccgaccgtggaagaaagcgtcgaatctctgaaggcgcagatgacagacgcgcagatggcgctggttgaggcatacgaggcggcggatgatcaggcaacgacgatcatgttggcgcagaccgaagcgtatgagacagcggacaggcagaacacagacgcgctgctcgcgctggccgaagtatatgaatccatgctcgcgctgcaagcgcgcgtggaggttctggaagggggtgaaaaagcaaatggctaaagtatatgcggagctgattcgcaagggcttaaagacaatcggggacgtacccaaggccctacaggccgaggttaaggagctgctcgaaaaatgagtagtttttttcttttcctcgcaaaaatcttctgccggaaggaggtgcgcataatggcggttgtttacgcgacgttgatcgtgaaaggcaaaaagacgctggaggacgtcccggcgctgctcaaagaacaggtgcgggaaattctctccgctctcgatgtggaagtgcagtaacatatgatggggccgggctggcagaacagcccggccttcaattttgcccagggggtgtaagtaatggcggatgagaaatgcatcgtagacccgcagcgggattgccttggcctgcataaggcaatcgccctggaaaagcaaatgtcggaataccgcactcaggcgcgggaaacacacgccgaaatgttccagcgcatttcagcgttggaacggtccggctctgcacaggaggcgcgctatcaggcgatcatggacaaattgacggaactgtccgtccggcttaatgaggcgctagcgactatcgcggcactcaaggaaaaaccggcgaaacggtgggagagccttgccgacaaagcgatatgggccgtgctcgcggcggtgatcgcctttgtactgggacggatggggctgtgagactggaggaaatacgatgaagatcaattggaaggtacgcattaaaaacccgctgtggtgggtgcagatagcagcggcgctggtactgccggtgctcgcatacttcggcctagcctgggaagatatgacctcctggggcgcgctgcgggatgtgtttctgcgcgcggtgcagaatcccgttgtgctgctcgctgcggcggccagcgtgtttaacgctgtgaccgacccaactacggccggcgtcggggacagcaggcgggcgctcggatataagacgccgaatcgtgacgaataaaggagatcaatgcggatatcggcttgtaaaaaagggcggcgcatggtaaaataatactggcgctgtcgcaaacggcaggcggttaagtcttgcccctgaaagggggcgttgcatatggactatggttgggtcatccttgtgctgattttggccacgggttacataattgcaataaaaaaatgaccgcctcaccctgacaaagtaagcggtcattccgtaaaactttaggggctaaccgtctgtcgacagcgcctctttgtttttattatatccgtatcggggatatctgtcaagccgctggcctttggccggcggctcttccatcgttcacataagagatttgaattaaatataaatgtttagaaactttaatatattgattaaaaactatgattataattacagtttgggggattgcaaaaatgggacaagccatcaaaggtattgatatttcatcacatcagggagagattgattttgaacgcgtgaaggcggacggcgtgcgctttgtgatcatcaaagccggacagggccttcgtgagatggggacgttccgtcaaaaatacctgcccgctgtgctggccgcagggcttgactggggcgcgtactggtggagcgacgccgtgacggtcgccgaagctcaaaaggaggcggcggcattcgtcagggcgctcgacggcctgcgcccgacctatccggtgtacatggaccaggaatacgaatctccctgcggtaacgcctggggagtgagcaagggaaagcagcttcgcaccgacatggcaaaggcgttcctgaaggttctggaggatgccgggtactacgcggggctgtacgcctcgacaaactggctgcaatactgggtggacgacagacagctcatggcttatgacaagtgggttgcgcagtacgccgaaaaatgcacctacgcaggtagttacgggatgtggcagcatcatggggacgcgcggggctttgtggggcgtgtggacggcatttccgtaccggtggatatcaatgcctgctatcgggattacccggagatcatccgggcaaacctgctcaacggctggaaaagtgtggacaagccggacgcgtcggagggtgagatgctgtccgtatccacagcagaactgacggacttacgcgatagtttgtctgtagttctctcaaggattacaaagatgttaaaagctacataatattaatcgtaaaaataaaaaagccgcccaagagacacttttcttaggcggcttttactacacaataatactttaattattattaatttattaaatttgattgtctaaaattagacaaattaaggggttcgtaataaggtgctttaagaattctcatccagtcttgaggaaatcccatttgctgtaaaagtttttgctttgaaagcacttgagattcacttttataacgatccatggcaccttgcaattcagaagaaaaatcattaaaatcatcatcatctaacatatatttaaagcaaataacaagcgcaaataagtcatttctgcctttttgatctacacatttcatatatttgtgaatatacatattaggtatagaccgtttactaactgtaaaattaaacagccgttcgttatgagcacatacatttctgaagaatgtaatgaagatcaacatattttcaacttgattgcgacgtaagcaagaaaaatttttactgatcgatgtttgtaagctatcagttaaacattgaaacatttgtgatacttgaccaaaagttaagacattcattaatacccataaaggtacatttttatgtttatcacaataatgctttatatatttatgttccatagaatgtttataaattccagataacttgttcaaaaatttattagtattttcaagattttctgctgtatatttgtaattattggcattgaaatatgcgatttgttcatttccatatttcaaagaaaattcatatgaaatgagagattttatgtgccgttcaattactaatatatattttaaaaatataagtcggattcgttcgtcaaatttatagagagcatagatatcataaaaggtggccccagaaatataaagtttcttattttctggtctcttaaaaagttctttgtacccattaatcagagcaaagtagctttctttttttagaatttgtatagcagacgcttcatcagttattgttaatcctttatcagatttaagaaaatcgatttgttcttcatatgtagtgaattgttttcccgccatattcagccctctcaaatatgtcgtaaaataacgaaaagctccccgaagggggagctttccgggttgtaggcttctcaagtttctacaacacgttcagtgaatccataatatcatattcccaaacctttgtcaacataatgtgacccaaaattttaggcgtattatgaactcataatatagtatacgcttgaataattaaatctatacttgttacatcagaacttttttcataatagtcacgaattcggtagagaagaaattattgtccaatattacacaacccaaggattgggaaaaaccagatgcatccgatgtgtgagggaaagaaatgatctcaattttaaaaccggagatggaagggctgcggaacggtcttgcggcggcgctcaattcggttacgcggatattggggaccgacaagatataataatctaatgatgcaattactctacgcaagttttttcattcaatatgtttttatgtttagaccaaaagccccccttgcaggaatcgttcctgcaaggggggcttttggtgtttttacggcttcgttctagagggctttttagaacgtttttgagcgtgggggggcgtctactctcccatggcgcaaagtatccgttgcaactcaagtatggggccgtcaggggcatttctaaccgtttgccacaatctccactgcggcaatctccaccagatcgtcacgaacggcgccgacattcagcgttgagccgacgcgatagtaggccagaatttcttcatctgtgccattgatgcgcgtggtgatggtgttcccgtcggccagcgttacgcggaccagcctgggaccaccttcgggcggcttactgtccaccgcccagcccgattcctctagatcgtagaagccgttccagttagattcctttctgccctcgtaatcttcggggcgggcgatgcgaagtaatgcgaagtaatgcgaagctgactcccttacctctcttggctctcaaagtccagatgtgccgacaatggaaaatccgtttgcaggcacagaaaaccagacgatcaactttgtcgaccttgcagaacagaaatataaaattgtccgattcggacagaaaaaagccagcgggagcacgccccgctggcttttttgtttttacaggtgagtatcaaacccggttacgctggtaaagatgggttgcagttggtcgaaataaacgccgcttacttcgtggatttctttcaccttttcgctggtaaaggtaaaagttttggtattcatgcgcggggcgatgtagcggaaaaaccgcattgtgtaggtatccgttatttcgtcaagcgtgatataaaggcggttggccttgcttccgtttttcggaagcgtcattcttaaagtgtttccgtcgcttacaaagtggcttgcgcccgtcatggcaataaatttgttgcctccaagctgttcaagaattgtgcttgcaatattcattgtttcagtcatttttgattacctccgcttgtttatttcctttaccttatgtacctattatacatctaacgttagataaatacaataggcagagtatataagtctaacgtcagatctttgtacaatctaacgttagacaaaatgggcgcaataaggtaaaataaaataaaggtggtgagaatatgggacggccaaaaaaaccggacagcaacccaacagattataaacgcgggttcaacgctgaaaattacgaacgcctttacccctgggcgcggcgggggcgtaaagccttttacacaatggcggcaaaacaagccggactttcgttaaatgaatttattattgcagccatagaagaaaaaatggagcgggacagtccagacacttacaaacagatgcaggaggaaacgaaaaactaaatttcaaaagccagataatagcacatatcgactttatgcagaacaaggaggacgatttaagtatggaggcccaaaataaaaaagtatgcggggtggaaggaccaggttttggcccttggtgcgtagactgtatccaccaaaatgcagtttatattggacgcaaaacatcaaatgaaatcgaatacgatgggcagcaatgtctgcttggatacaggtgggaagaaggcgctccatatcctgataatttctaaatgtacatgcaataggctaaaaagccataaagaaaaccagcgcgatagattgcagcctatcgcgccggttttctatttttcgttttctttgtcccgcataaagacacagccaaaaagcccatggacaaatacaaagtaggggtttgctttcttaatgggatgctcgaccaaattagacaaaacccatgtataacatcgttatatatgggttttgttatttttatggtgaaaggcacaaaataaatgcacttcaattgtgcaaaacaacaggacaacttaaatacaaataaaaataaggtttcatattcctatgttttacctccgttagcggaggtaaaacataggattttttattttaaggaggttttaaacatgagaataccatatggtttcaatctgacaacatccggcgcacttgagattaatgaagctacagccaaagtcatcaaaaggatctttgattcttacatgaccggagcaagcttaggtaagatcgtggaaatgctctctgcaaaacagatcctttcccccacaggaaaatcaaaatggacgcgcgcaaccattgatcatatcctctcgaactccaaatatattgtcatcgttggcatggaaatgtatatggatgtacaatttgaaaaggctgcccgctgcaatattgattacgatgaggtcaatacacctcgtaaatccagccgatatgtttcgccctctgtaattcagaaatcattttgattcccaatcttcaaaatatctgttacaatagttttaggggtgatccatgtgacagatgagaagaaaaaaggaattcaattagtggatttggcagggatcggcaacttgttggagcatcttgtatcggctggctgtatctcctgtgaagaacgagatagaattatatgccggatcgcacaagacggcaatttcagtgaggtgtccctttctgtgcttgccggttataggcgaagcaaaaaggatgtgtctgagagaactacacacagaaaactttcggaagtattaccaacatgcagtgcgtcgaatgaagaatatgtatctctaacagagctggtacgggcgcatagtgaaggcacaccaggatatgtgattcaaagctggctgcgaaacgagaatacattggcatttttgaatctgtgggagaaggagaataacccaacctattgtgaacatgcttatttagagttgttggagaaaaagaaagcggcttcctttacactaacaccaaagcagtggatcgaccagacaaaagcgatcggcatcgtatcaaagcagggaaagcaaggaggcacttttgcccacccaatgattgcctgtgaatttgcttcatggctcactccggagttcaaaatgctgctgctgaaattatcgttgatcaaggctcggttggggtgaagaaaatttcttatagatggatttcgtagcagttagagaggttttcaaaagacaggaacgttggaaatgaacacaaaactgaaggatgcctgaacggaaaatgctgaaagtcggcagtatgtggaggttggagttcctcaataaaacaaggaaagagatacgtaaatggtatcgaatcgcaaacttctgtgtgcatatgatttgaaaaataatgtctaaagaaaacaaaaagatcgtttcccctatactaagcaaatgaacggttgatggatgcccagcataaataacctcttttatatagcagctggtaatagttccatacactctcatagttgatccattttccagtatttttgtggaggagatcggtagaaaatttccagattattagaattttccgtctaaagtagtggcagtgtccagggcggttccaaactgggcaggtttgctaagttggaagctacattttagcctagtagataaggccaaaatgtagcttttctctatgcaattttccgtgaagaaacctccatgttatactgctcataagtatatgagcggaatacatggaggttttgttatgtcaaaaaatattatagagattccacaaagtaaagaacaaaaaaaccatttggcatcagcaactcagggttgccgcctactgccggatcagtactaaccataaagaacagcaaagtagtttgaaaaatcaaatcgagttctataccgaatacatccagaggaatccctcttggtaatttgttgcggtctactacgatattgcatccggtctgcgaacaaacaaggcccggtcaccagcagttaattagagactgcacaagaaaaaagattgacctaattatagtaaaatcccttagtcgattcgggcgggatacagtggaaacaatcaaacaaatacggaggttaaaacaaaaggatattggcgtttattttgaaactgggagtatcaacactctgactaccaatgatagtgtaattgacatgttggcagccattgatcaagcagaaggccaatcccgtagtgagaacatcaagttcggcatccgtcaccgtatgatgagcggcaagacacttcttaaccacactcggttcctgggatacaccaaaggaccggacggggtgttacagattgtcccagaggaagctgaaatcgtgcgaaagatctttgacctctttgtacgggggaatggtgtacgcaaaatcaaaaagtatctggagtcccatggcatcaagactgtcaccagaaaatcagagtggagcacctccactattgactggatgctgaacaacgagaaatacatcggacaagtgctgatgcagaaaagctatacgccgaattttttgactggaaagaaggaaaagaatcaaggacagctttgatgatatggatattgtcacttttttgtattctgattcctattgatcattggcttgaaaagcagttttattgtgaccaagagagatgaagaaactgttcggtcaatccgatcatgcttaccgacctgattgaggaggcgaagaatttgtcaaagtgtttcatctgtggtgcagaattgacgtctgaaaacaaatcacaagaacatattctgctcaatgcgcttggcggaacattgacttcaaaaaatctgctctgcaaacactgtaactccattttaggaaatgatatggatgatattttggcaaaacaactccagccatctgcgttgctgttggatgtctccagagactgcggcagtacgcctgccatgaccgctgttcatgcgcaaccaaagaggaaattcttatcttaccaggtggaaaaacggctatgaaaaaggcttcatgttcactttttcgaggagaacggtgagaaaaaatatcaaattatcgcgagaggcaggcgagaagcaaaggcgattttcaagggggtaaaggaaaaatatcccagatcaaacattgagcaccttaaagaaaaatgggatccggtcaatgaggatgtgtcgttccagacgaccttaggtggagatgcgtttctatctctttgcaagacggcaatctgttattatttgtactgtggaggggaactggcagagattcagccttttatcactcgatggcaagataaagacatttggaggactgcaatttttgttatatggataaaccggttgtctccaaggaggaagatgcagtttgccactctctggttatggtcggtgatccagagaatcgtcttttatatgtttacatagagttatttgatttttaccgtgttttagtcctattgagtgatcattacacgggaccagaaaaaaagcatctatgttacgatttgatctggaaaacggttgtagaagccaatgttggaatgttgctgtcgcagcagaacatcaaagaaattcttgcaaaagatggggttgaatttgagaagcctttattgcgagctttgcgttcaacaatggagaagattaaaataaagcagctgaccgagcaagtatggaatgaaatatttcagaatatcggatgctgttatccagagtgaataccaacatctttattttccggattattcgcagagaaaatgattcaaaaactttatattcctcggtcgagacagtaatgactagcgaaattaaatcatagattctattgttagtacgagctccaagctatcagacaggaattcggaaccaattcgcgctctgagtcctttgtgttacgccagtattgcgcccgtgtctaaaacagacataaagcgcccccgttgtagttctatcctacttcgggggttatttctttgcaactgccctttagcccaacgcagttcaattgccggcgcttttattcccttttataaaatcgtagcgtcccgtgcatattcttctaaatatttgctgtaatcagttaagaattgctccacgagtttgatctcactatcggtgtattgctccaacttttcggtgagatagatgttttccatccgatgataagcgtcatgcgtatctacagcaattttgccgcgttcagtcaggcagcaaatcagttcttttttattgcggccttgccggacggtgagcagttttttattttccagccgccggaccaaaccggaaatcaccatcttgctggccatcatttgatcagacaatgtagttaaattacaatcgggatgcttatcaattagatccaacaaatgtatttcgtctgttttcagaagaatatcaatgccataattgcgcggaagcgcatcgctggctttttgaatacgggccagatgatcaattaaggagcgaaaaccataaggctttttcatcagaaatgcaccttccgtgtgtgtattgtttccattatagatgtacatgcatgagatgtcaatttaacagcattataaaagaactgtaaaatgcaattcaaaaagtaaatatctttatattttttatttttccataaaattcaaacagctttaattttaaaaaatatgttatttttaaaattaaattatgaaaattgctgaaaatagagcttaaaaactataattatcatgcattgacaaagaactgctttaaaactatacttttaaatagtaaatatatttactatttaaagacttgtttgatatttagtgaagcaataaggggaggattccattggaggtaagatttgacaacgacgcgatccgttttgatgtgctcaggcagcgcgcttataatatgagatgggctgagcaggatacgggagtaattccactcactgctgcggacatggatttttcctgttctcctgatattgttcaggcaattgttgaatatgcgcaggccggatatttttcttatacacccaaaacaggtttcccggcgtttaagcagagtatcgcacgcgcactgtgggaaagaaaaaaagaacctgtggagcctgatctggttctgcctatagacagcgcagcgcgcgccatgtccgtcattgcaaaaacagtgcttaatcctggcgacgaagccattgtatgtgatccggtggattatctgtttaaaacatctatggaagccgcaggggcaaagattgtactgttcccaatgagtatcaaagatgggcgaatcgatttttcccggttggaacaatatattacacccaaaacaaaaatatttgggttatgcaacccgcataacccgctgggaatgtgttatccgctggaggatcttgattatattcttacattgtcgcaaaaatacggcttttatatcatgaacgatgaaatttggagcgatatcgtttactctgacgcacaattccacagtatcttggagcttggacccgaacgcaatgcgagaacgctctcggtatatggattttcaaaaagttttggcattgcaggtctgcgggtaggctgtctgtatggcatggaaaagaacttgtttgagcatgcagtggatatcagcgaagtgaacagcacaatcggtggtatttccagcttatcgcaaattgcggggatggcgtgtttagataaatgcttcccctggctggatgaatttgtaaaacatctgcagaaaaatcgtgattatgcgttggagcggattcggaaaatgccgggtatcagctgccataagccccaggcaacctttgttttatttgcgaatatcagcgaattgtcaatgagtgctgaagcatttgttgactttgccagaagggaatacaagatagctgtcgtccccggaggcgagaagtttttcggcccaggctcggaggggtatatcaggatctgtctggccacaagtcatgaagtgctaaaagaagggttgaatcgtcttgagcaggcattgacagccgtaaaagaagggcggcacaccaatttaatgatgtaagtaagaaggagagggagaaccatgttaggaaaagatgtttttaatggcattccgatgatgatcctgtgcgtgctggcaatgataattgttgtaatccagccggtcctgttcctgtggctttcatggaaacatgggaaagagatggggatcaaaacacaggatatgaagggctgcgtgcatagtagcatcctgttttctatcgtacccacgttaccggttctaattaattatttggtgctgatgcctgcattcggaaaatattttgcctggctacgcttaagcgtgatgggcaacgcagcttatgaaaccgctgtggccgatatggcggcgacagggctggggtttgaaagcgtttatgataataacatcgatctgcaaacattcaccactataatgttcgtggtgacgatagccattttgggcggcgcaatttttacgatgctgttcactaagttttatgagaaaaaagtgcgtactgtggctacaaaagtaggcggcggcaaaatgatcggcttaattacgacagccatgttcgtaggaatgtatagtactctggcggccccccatgtgacgaatgtggaaaaaccaaggggaattgccgcttttattgtagctgttgctgtcacagtcgtgtgcacgcatatctctaaaagatgcaagggccttaaacagtttacttttacgcttagtatcctggcgggtatggcatccgcttcaatcatcagcctgttttaacagagaaatccgatgttcagcaaggagagaatacaaaccgtgattgtattttggtatgatcatctgccgatatctgattaagctatgaaaaagttttaaatgaggagggttttatatgaaatcaacaaattttaaccaaaaggttcatttttggggcaggctgacaattttgatctgcatgattggtctgttggctgtccctctgggaattgcggtattatataatgtacaagtgtcctggtccacggtattcagcgtatctatcagcccttttattacttataccatttccagcgtcatcggcctgcttgcactggtgcccgtcatcggaggaggcgcgctgtatgtggctaacgtaaccggcaatgtgaacaatattaaagcgcctgccgccatcaatggtatggatatctgtgatgtagaacctggtacagaacaaggcgataccgtagccataatcgctacgagtgtaacggcgttggcttctactgtcatcatggtaatgggtatgctgtttttggcgcctctttttcagccgatttatgagaatcctgttttcgcccctgcttttgacgtagtgctgccgtcattgtatgccgccatgctcacgccatattttcttaaaggtgtaaaggaatgtatcgttccgtttctcctgcccatcgtattgcttctcgtcatgagccgctcgctgttttcctcttggtccagttacatcatgctggcgatgatggtggtgtctgtaggttatgtgtacctgctgcacaaaaaagaccccgaccaaagtgctgaaaaaatgcagaaagaggactccaaaacagaatgacatctttatagcggaaaggaagaatgtatatgagaattatcaaagcagaccgtgttattaccggcgatggaaaaaccgtattggaaaactgttcagtggcgttggatggcgctcaaattgcaggcatagggacgctggaggagctgcgtcagaaattcccccaagctgatatccatacgatggaaggccatacgctgctgccggggctgattgatatgcatgtgcatatcagcggcctgtaccgccgccctgagaagcaggagatgcaggaaaatcccgcttacttgatgctgatggtttataagcatttgcaggatgccctatctgtgggtattacaacgctgcgcggtgtgggcgaggccaagcatatcggcgctgccattcgcggagggtatcgtaaaggttacatcaaaggcccgcgctatatcacctgtgaacgcagccttacgcgcaccggcggccacgggtctacgggcgaagtggctaaaatagaagtggatggcccgtggaatttgcgtcatgctgtgcgcagcaatatcaaagagggggctgactggatcaaagtgatggacagccaccgcggccacttcagcgagttcacactggaagaactgtgcgcagtaacagatgaggcccaccgtctggggcataaatgctgtattcatgccggcacggagcaatcggtggcatgggcggtggaagccggtttcgattccattgaacacggcgcttatttggaggaggatttagcgcaaaaagccattgaaaaagggctggcctgggttccgaccatctatgtgtatgagaattctgtggactatatgaaaaaagtaacgccaaacccgacaaaggcggatttggttggaattaaattccttgaagacaccgtaaaagggtatcgcagaaactttctgcgcaactataagaaagggattttggtggctacgggtacggatatttgctttccggaaatgttcattacgcctttgcaggaggaaatcaaaacaatgatacgctatggcctgaccaatttggaagccatccagtgcgcaacacagaacggtgcgaaaattttggggatggctgatgaaatcggtacagtcgctgagggatattgtgccgacctgttgctggtagcgggcaaccctgcggaagatatagacgctttggatcgggtacaagaagtgtaccggaatggcgaactggtgtatagcgcgaaataactgaaaaatgaaactgttaacaggaagccgggagtacatactcccggctcagcttgtataaaaagcctgtactggcaattggaccgcctcagattatataggcagcacacaaaaaagcccctgagcggaaatattcggttttagcagaagtggcgcagagtcagcggcaccactactgtgataaggttaaataattttcgcagcggccgtggcttggacggaggaaagctggtaatgggagataagtgtcttcgtatgctggaggctgtgggcgaagtgttccccgaagccaaataccaacgatgcactgtacacttctcgcgcaatgtattctctgtaacacctcgctccaaggtgaaactggtagctaaaatgctcaggcaatccacgcccaggagagcaagaaagctgccagggagaaagtcaaagccgtcatagaagaacttcgttctatgaaactgaaggaggcagccaaaaaggtagaggatagtattgaggagactctcacctgctgcgatttccccagcgaacactggactcgcatccgcaccaacaatgtcattgagaggctcaatcgggagctccgttgccgcacccgtgttgcaggtagtttcccggatggtaactttgctctcatgctgatctgtgcccagctgcgccatgtggcgggcacccagtggggtaacaagaaatacatgaatatgaagcacttggaggctgccagcgaggatgtctctattgcaggttgaccttattcatgccaagatctgtaaaccaaagcacgaaaaattcttgacacgacctacaatgctgggtatctattttgtcaacgcttcccaccgggcaagggtctggagccacttcgcgctccgggtcttttgatttgcccaagattttcgcccgcgtctaaggcggatctaaactgaccacccctggcacgttggaatggactgcgctccattcaaaaagcccggtctttgaccgggcttttctcataccgctccgtcctttctcatctctcgcaaaaggtcacacttgctgcggctgcttgcaagcgcgctcccgacacctccgccgcgctgccaaccttttgcgagcgggtacgggttttccgctgggattgcaagagaattgctccccgcaagggcggttcctctacaaacgctccctcccttttgcatggtcgctactgctgccgatttttttacttttcggtcccccttatccgcatttttctcctgtgcggttctgtgttcagccactccgctagggcggcttttagaatccggtagccccggcctgcccggacagccgggagcggtccatcggcaatcagccggtggacctccttgcgcctcactcctaggatctcctgaacttccccggtgcgcagaacctccgaccagtccgccagcatctcccgtccaccaatattattctgtcccgtccattacccctttccaagaaaaaagtcgaaggcatttgccttcggctttttcagttctctgccgttttttccggcggttcctcacccagcagggagcccatcataccagtcgattccaccagcgccctggatgccaggtgcgttttaatttgtgcaatttgttttaccttatcaaactactcgctaggcgagtggttttcttcatacaaaaaggtggtatgctcccgaaatggggaacataccgccttttgttatcaaaaacctgttttacaagctgcatctgtcacttgataattgtctcggaaggaaaatcttcactccagtcaaacaaagctttcgatttgtgctggcggacatattcttccacttctttgtacattttcttttcaatcatagaaaggatcgtcagatgttcctgataggaagatgccatgcgttgcggcgtaacggagaaaacccgggttgtaaaatgccatttatcccaaactttatgaatcaaatccaaaagatctgcattgggaaggtgctcataaatagtattgtgaaaaaggaagttcaattcagaatataaatcgacctcattattttcaagtgcagcatacatttgttcgttgatattatacagttccctgatatcattgggcgaaagataatcgatacaaacccgagtggcgtatccgcccaggacgctttttacttctgcaatatttaaaatagtttcccgcgtaaaaccaactacgatggcgccgcgattcgcgctgattttaacatagccgtcgctttccagcatacggagcgcttcgcgaacaggagtctcgcttgtgttgcattttttggaaatttggctgattacaagacgttcgccacttttatagttgcgctgaattagctctgacatcagatattcgtatacttcgttcaccttggtcagctgcttccccatgatattactctccaaatatattttgtactaaaataatatatcaatattatatctaagaaagattgctaattgcaagtgctaatttcgtttctgtaagtgtcattgtgcgacaaaaaatgacaagttcattatgtagaattcacaaaaattagaaaattgtaagaaatgagttgcattgagtagattatatatacataataaataaaatatatgatttttatatattgtatatttttgatgagatttattgaaattattcaaaaaaacgcaaaggaggcatattatgaactattattctgaaaacaaatggtgggcaagcccattcaatgaagaaaaagaagtgcgcgcacaacttcaaatggcaaaacaagtcaagatccatgatgcgaccttgcgggatggcgaacagactcctggtgtggtattctctatcgacgataaggtgaaaattgctgaaatgctcaacgaaatcggtgtggagcggattgaagcaggaatgccggccgtatcatcggatgatgctaaagcgatccagttgattgccaatcgtggcctgaacgctgacgtttatgcattcgtccgggcaatgcataaagatatcgaagttgcggcggaactgggggctaagggggtaattattgaaatccccataggttatccaaaattaaaatatcagtttggttggacatgggaggatgttgctgcaaaaagcatcgactgcatcaactacgcaaaaagctgtggactccatactgtgtactttccttatgatacaactcgggctcgcgcagaggatttggaaaatgttatcaatactttgatgcgggaagcggttccggattccatcggcatagtagacacaatgggctgcgctctgcctgaaacgatacaatatctggtccgaaagttgaaaaggcttactgatggcctgcctgttgaagtccatacccataatgattttggtatggaagtagcaactgaacttgctggtatcgcggccggcgcagattgtgtacatagctgtatcaatggtttgggagaacggaccggtaatgccgctttggaagaacttattgttggtatgaagatcctgatggggctgccaaatgaatataacctgagaatcctgcctgacgtatgcgagaaagtcgcgcagatttccggcatccaactggcccctaataaacctgtttcggggatacgcaattataccagagaatcaggcataggcataaatttggtgcaggaaaagccgctggccatgtttgccaccgatccggcgctttacggaaaatccggcatcattgcattaggcaagaaaagtgggaaagcttcggtggaatattttttggataagctccatctggaagcgacaagcgatgaaattacagagattcttgctcgcgtaaagtcgatggggcaggaggaaaaaagattgctcacagaggaagaatttttggggatctatgagtcagtacgaaaatcagcataagagtatgtatacagcttggccaagctggatttttccggtatttacaactaattaataaggaggaacagaatgtgatcgacctgataattcggaatggaacgctggtcatcccggagtgcggccttgtggaatctgcagtggcaatcgaccgggggaaaattgtggggattggcgattcgacgtgcctcccgcgcgctgcgcgcattattgacgccagggggaaatatgtaattccgggtgtgattgatccgcatgtgcatttgggcacaagtccggaacagttctcctcccttgccgtaactgaatccagggcagccgtcattggcggtgtaacaacggtgggctgttatttgcgcgataaaggcagttatctcagctcttattcggactatatggatacgatccgcaatggtgtttataccaacatgtgtttccatgtgcagatcagtaccgaggaacatctcagcgagttaaaagagtacgcggagaagattgggtctaatacgtttaagttttacatgtgcggaaatgcaggtattgtggagagtgccagcgatggcttcatttacgcaggatttaaaaaggtcgcatctctggggccgaacgcattggcgactgttcatgcagaaaatgaaagcgtgattgaccgttgtattgaagaagcgaaagcccaaaaggaagacggcggactggtggactggtatctgactcgtccttcttttgcagaggcggaggcggtcgttcgggccgcccaactggcaaaggccgcgaaggtaagactttactgcgtccatatgacatccgaagctgcgatgcagtgcctcaaagagcttaaaagggaaaacagaaacctgtatgctgaagcaacttcagcccatctgggtctggatgcggccgatccaattggtttgatggcaaaaatgattcctccgatccgcagcaaagaagataaggaagccctgtggcagggagtcagggaagatattgtcgataccttcggaacggacaatgtgacaagaagtctggcggataagcaactggaaaaagggctatggggcagtaaaaccggatatgccgttctgggaacccatttgccggttcttttggacgagggataccataaacatggtctgccactgaagcaaatcatccgtaaagccactatggcgccggcaaaaatctttggtatgtatccccaaaaaggaacgatacaggtgggatcagatgcagatttggtgattattgaccttgatatggtgaagaaggttgctcctgccctgattggttcctgcagcgatttttcgatattccaaggaaaagaattgaaaggctggccaatcatgaccatagtgaatggtgaagtaattgcggaagatggccatctgacccatacaaaaggaaatggtagatttatcccaagacatgcataggcgattttgaggtgtaaatcatgcagcttacaaagaatgtccatgtagaaacaaaaatttggggatgcaatatcggataccttttaacagatgaagggagtatcctgatagatactccccaaagaccaacggtagcaatgcagttaaaagagacgctggagtccttttcacccattcgatatattatcaacaccgaatgccatcgggatcactttaccggcgcgggctttttcactgcccccgttattgcccacgagaatacaagagatgccattttaaagacaacaaaggaaaatgtgctaagccgtgtgtccgttatagacccggagggatatcagctcatggagtcctggaagatcaatccgccggtcattactttcagcgaaaagctcacccttcatcttggcggcagcaccattgaatgtctacaccatccaggacacacagatgggcaaacaagtgttttgctcaaggaagaaggggtactctttacaggagataatgtatttttcaaaacgcaggcttttctcaattctggtaacgtatatcgttggatggagtcgctagatgagattgcgaaacttgattttgaatatattgtccctggccatggcgaggtctgcggcaaatcttatctttcagaacaaaaagaatttattgcagagtggatacaagcggtgagaagggccattgacaacggctggtccaaagaagaagctgttgcaagaatttcctttgaagaacgctatcctatgtcgataggaacagaagatctcatgaagaacgtccaaaaaaacaatgtgtcgtatttatatgacatgctgttaaaagaatccgttgtctcaaaataatttgaagttgtccaaaaaggagattacagaatgaaggaattggtcgtcagtaaggacttttttatcacggatgatttttcccagtcatataaggtgggaaacctgctttttgtttctggtattacagccagaaacaaaaagggagaaatcatagaaacagattttgaggcgcagacggttcgaatctttaagaatattgagttgatcttaaaggaggccggcgcaacgctggatgatatcataaaattcactgtatatttgaaagatatgaataatgttaagcttttccgggaaatcagaaaccgattttgttctgttccgcgcccagccagcacggccatcgaagtaacgggacttgtccctggcgcaatcgtagaggtcgaggtcgtggcagaatgcgggggatgctgatacggaaagggagcatatggaggagaagatatcattgacattggcctgcggcgactatgaccgcacgcaggcgttgctgaacgggctggttcccataaaggggattgctctgacgtgttttgcgcttgagccgaacgagacgttccgcaggatgttggggaacgaggaattcgatgtctcggagatgtcgctgtcaaactatgtgatggaacgcagcgaagggaattttcgctttacggcaatcccggtgtttctttcccgtgccttccgccattccagcatctatgtgaacgcacgcgctaaaattcgggaagccagggatctgatcggtaaaaaggtgggtgtttccgaatatcattccacggcggcgctctggatccggggtatcctgcaagatgaatatcaaattgacgcatccaaactcagatgggtcagcggtgggatggagcggccttctgaaggcgaccgcatgaagaatttcatgcccccgccgggagtgcggatcgaaaaatccggaaccggacagtgtctaagcgagttgctgcgcgcgggaaaaatcgacgccttaatcaatgcgggcaagcccagttgtttcgacaatgaaacggtatatcggctttggccggactatcggcgtcgcgaggaggactattatcgacggacaggcatctttcccatcatgcacaccgtagtagtcaaaacaaagatcttagagaaatggccgtggattgcgaagaagctttttgacgcgttctgtgaagcgaaaaagatggcgcttgaaaagctcaatctgaaagggacgcttccggtcatgctgccgtgggctttttctgagtacgaagaagcggaaaactttatgggaaaagacttttggtcctatggccttgtgaataacggcaaagttttgaaaaccgttcttcgctactcatatgaacaggggctaagtaaaaggctgatggatccggaggaactgttcccaacttttgagtaagacaaaatgaataccattgatgaagcatgatcccgcgacagtgttgcctgtcggggaatgcaataaatccggtctgaaaaatcgtaagaatggaaggagatttagaatgaaaatttctaggaaagcaattgctttgatgatggccgcagcaatgatcgcgacactgaccgcgtgcggagcgcagcccgctgaaaacagccaagaaaacagccaaacggaagaaacatcgacctataccattaaaataggacatactcttgctacagccactcctcagcatcagggccttttgaaactggagtccctggttgaggaacgcacaaacggcgctgttcagatcgagatctatccatcttcacaaatcggtgatgaaagagaactggttgaaggtatgatgatggggacggttgacggttatctcggttcgaatgcaaccatgactgcttggctatcggactttatggtctttgatatcccttttatctttgacagctatgaccatgcgtttgcatgttatgacggtgaaatcggagacctgctcaagcaaaagtgtgaagaggttggcgtccatgtccttacattctctgacgcaggtttttccaactttatcaccggagatactccgattaccgttcccgatgatgcaaagggtctcaatattcgcgttatggaaagccccggcctgatggcgtacatgagcgcgattggcgcaaatccggttccaatgggtatgagcgaggtgtttacctccctgcagaacgggacactggatggcggcacctggccgatcgtagtatcttacaacaaccagtattatacagttattgattatctgacttatgtcgatgccgtggccacttctatccagacttccatcagcaaatctgtttgggatgctctgcctgaggagtatcaggaaatcattacccaagcttccaaagaggccgtcgagcatcagcgccagttgctcctcgataatacggatgctctgctgaaagagatcgaggcaagcggcgtcaccattatcaatgccgaccgtaaattgtggaaagaaacagtttttgattattgcctggacgccatggttccccagtatgtttctcaggaactggtcgatatgatcaatgctcagaaataacggtttttccgtgaaacgccgcctttgcctgaagttttgcttatcgcatcgcccagtaaaggcggcagttcatctttaccaggaggtaaaaaatgcaacaaaataagaaaagctttgtcaaaatacttgatggatatctggataaagtggaaataacgattgacataatcgcctttctgggaatgacattcacggttctgatctccattatacttcgctatgtagtgagagtccccaatttggttggcgaagaaatttcccgctatttcctggtgacggtggtttttatcgggattagtatgtgtatgcgtgtaaagggccatatgggcgtgaccatttttgtggaccatctgccttccaggattcaagccgtagtaagatgctttgccgatctggtctcgatcgtgacaatttgtggggtaagtttttttgcgtggaagtatactttggcggcggtggaacatccgcagataagcgttgcgaccgctttgccgatgtatgtgatgtacgccgtgatggcttcaggttttaccctctcggcaatccgccttcttatattgttttggaatgactacctttccacaacacatccattaagtgaaaaagagggagggaatggataaatgatgatcgctgttatattcggtacatttttgctggcgcttctgattggttgcccaattggtatcgctcttttgctgggtggcggtattcccattttaacgatgacgaatctggatagtgccattatcgttcaacgtttgttctccgcagcaaacaactattctctcatggcggtccctttctttattctttctggaagtttgatggatgtcggcggcgtttccaaacgccttgttaattttgcccggtcgcttgttggatggttgccgggcggcctggccgtcgtatcctttctggcctgtgcattctttggagcaatcaccggatcggcaccagccaccgttgcagcaattggctcaattatgattcctgcaatgaaagaagacggataccccttaccttttatccttgcaacagtcgcaagcggtggctggctgggggttatcgttcctccgagtatccctatggtcgtttatggtgtttccgttggaaccgtatccatctctgaactgttcctgggcgggattatccccggctttttgttggcaggaggaatgtcggtatatgcgatcctctggggaaagaagaatatgcctcacgccacaaaaaagttttccattcgcgaagtatggagttcctttaaggaggccctttgggcacttggcatgcctttaatcatcttaggcggtatttatgccggtatctttactgctaccgaagctgctgttgtctcagttatttatggcctgctggtcagtacccttatctatcatcagttgacactcaagggtctggttgagatgatgagaaaatcaatcattacaacaaacgtatgtatgtttattgttttgacatccactgtttttgccgcaattatgacccgtgagcagatccctgtaatcgtaggcaacgcgatcatgggcatagcaaagacgccgcttatgttctttgtacttgttatcctccttctgttatttgtgggaacctttatggaaacccttcctgccattatgatcctggcgccgattttgatcccaatgctttcaaactataacgttaactcagtttccttcggcgttattatgatcataacactggggatcgggatgttgactccccctgtggggatcaatctgtttacatctgccagtctttgtggtgagaaggtggaaacagtgatcaaccgtcatctgtttgcctatattggatgtgcgcttgcagtacttgttcttttgattgtatttgatgagattatcatgcttcttcccaatattgtaagagcaaggggatagcattcggcttccctgcgcaatcgctgcgttcctttgcaggtgtaccatccggccgctatgccaaacaggagccaggtcgctgtatggcttacgaacggtaaagccaggtgatatagcaatttcaaccgattgccataagtggcaagagcctggagccaattcgcgctccaggcctcctatatccaaagagctgcccgtgtccggggtggttccaaactgggcagacttgccaaaaaacaaactcactttggataccatcggcagaaatgccgatggtatcgggcttttcaaagaatttttcccttcaaaattcaaaggtaaaacaaaagatctaaacaggagttttatacaggccgaagggattaaaaccccaaaaacccctcaaaacctataccctcctttttgaacaggagatttcaagaaggacgctaagttttttattcaacaaaaatcagagtgtccaaggtgccgctctcccagccaacgcaggctgataggcaggctggcgtctttttcgcgctcaaaaaggcgctaagctaaggtagaaccctataaggaagtaaataaattttcggtgaaaccggtgtggcagagattacgccggtgtttttgtatctgtcagtagtttaggtttcgcaagcggaatccgaattttccccacatagatgaagcggacttcaatcgtgacatgctttttcccgccgattttctccgggctgtgaatcaccatctttttaatcagttcatttaccatagcagcttcaagctcctggaagttggaatacctggcggcaagctgttccattaaccccctgctttgtcttgtgatcttccgcgcacttacggagaagctggatgcagacgttctctgagatgcgtcccataactttttctccagatgttcccggacgccctgggcccgcattaggcagaaatcccggatggtatccactctaaaaagaaaatcctcgtaggagcagaaagccgtggcgtcacgctccacataaggagcgatcatggtacaagccttagtcacgaagtctttaaaatagccgttttcaaaatacccggagatcaactgatcaaaatatgcgcgatacttggcaaaatatgtgctgtttttcatcagattgtggtatagaggccgattcaacatcacttcgccctcggtgggggtgtggatggggtagttgacatagagcgtggcgttgttgatgggatcaggcataccgagagagtaagtggcaaaagccagattatagtcccgtgggaggatttggagaagcccattttcctcatacaagaaataagtatgcactatgcggcccagatagctgtccatgttcaccacaaatacctgtacggtataataacgaagcacctcatccacatagatggcagtctccagatcctcgcctgtggaaaggacttttagggcggagatcaggcgtcttttgtcggcgttggagaggtcaaacttgccgtttcggaaaatattatgataattttcaaacgcatcgtccgtgtagcgcagagctacatcagcattttctgcattaagggatgaataatctagcttgtagagccgaccgtaatcacggccaaaatttttccgggcaaaggcttcctccggttcttcaatggcaagaaacagacctcagtcctctccattcacacgcacatccacatagctgcataacggtgtgggtacgcccatatatgccatcatgtcatagacgatccatgttttcatatagctattgtcccgaaaggaggcgtccagcgaaaacttatccaaaccgtaataactgccggcggcgtagtgatcaaactccaccttcagactgtaacggtcatggccgtacttctccgtaagacggcgggagttgttgccctttgcccggatgcccacgtggtcaaatcattccctgacaatcatgatggtacaggtgctgtactgctcctccagcgcggtgtccagaaaagcctgccagtcgtcgatcagaatgtcgatggtgtggaagcgggacttgtcaaaaagccgcgtttcgtatccgggtgtggagaacgcaggcgtcggccccagcgtcttgccattcataaaaattagcgtcaacaccacagccaacgccatcactgcggcgcatagcttgtcgattccttccctctttaacatttcagctcatgtaatcgccgttataggacaccagtacggtattgctgatactccctagtacggcaaggtcgttgatgaagctggcgtcggaatccttaagcccaactcgtagttgagttcaatgctgcccggctgtacgctcttactcttgagggagaggcgcttgacccggatttgcagaaagctttgcgcggtagtcgatcagcgcagtgaagcgccaaaatatagggttggccaaagctgcggtactgggaaaagatcagcaggatcagcccaatgaacagactgccgaacatggccagaaggattagccctgccgccagtacaatgcctgcggcaatagaccagaacaaaaagatgatatcactaggctctttgatggctgtatggaaacgcatgatagacagagcacccaccatgccaaggctcaatacaatattggaggtgactgccagaatcaccagcgttgtcaccatagtaaggccgataagggtcacaccgaaggacgctgagtacattacgccagcatagcagcgcttatagacgaaaagatgtaaagtctcacagcaaaggcgcacgccatcgccagcaccatgtcaaagaccggaatgactgtcacgttttctaaaaaagcagatttgaatataacctgaaatgtcatcctgtcttgctcctaatcatagcgccggcagacggcatatttggaataagccccggcctttcggctgctgacctgaaccgccatgcgaaccagatccggcaagaagtcatcatatttgatctccaccacagtcgagccttcggataccggtgcataacaacgccgggggcaaggaaatccagagagcgcaggccgctgtgaagatttctgcccagcgtgagccgcacatttccggaagaatagagaaaggcttcccggtcataggtcacaatggttttgggggagagacactgcccttttattttgctgtatagctcttgcagcaggggatcttcgctttgcagcagaaaagtaatttttccctgcaaaagccgcttcacctgctatgactgtactaaggaccctgtgagaattatagcctcgatttgcgaaagaatcgtttctgcgtgaaggaaaaacgatatattgcgattatccgggacgacttggccaagctgaaagtggatctgcattttctggacaacgctctgaaaacggttctggcgaaataccggaattatttccagaaacggtttgtggagggcctctccattcgcaggtacgccgctgccaccagctcaatcgaggcagcgtggggactgcctgcaaaggaaattcttcaccgcccgtgcctatacatctcctgatagctttgataatctatctgtgtcgatgcagcaataaggccagcatgtcaagcttctccaatcaacgcgattgtcctctcagaaccgcctcccattaaatttcggttttcttcaagtttacgcttctcaagtgtaaatttgcgtttgagtgtacttctttcatcttctagtctcaaagcatcttcgctaatggcccaaaaaaataaggaattaaacggtaacaaaatcaatctaccttcggcttttcgggattgaaagcccccttatatctcttaaggcgattcttttaagcgcagggggcgtcagcaccggacagttttcttgattgtaatttccatcatttcttctacctcctccaccggccgccaagcctgtccaaatttaacgtcccggaacaaggccgctaatccggtaatctgtttgagacgcaggatctcgtccttatccatacccagatatttagaaatccagttgtcggaacgccccagctcatgcagctccttgatgatattgctcataagatccacgtcatgagaacccctggcgcggttatgccgaatagtacttgccatacggttcgacagaggcttgtcgatcaccgaaaccggcagcataccatgttcccgcgcgtagatgtcatgatgctctttcatcacgcgccagcgatggaaaccgtctactataacgtacaaatcctggcttttggcgtagtagcagacgacaggttgtgtatatccatcctctaaaatgctgcggtagagcagccgcatctccggcggcgccaccttatttgggttatatgtatttggctttactttttcaaaaggcacagcgattacatggtataccgggctgacatattcgctatttgtcaagcagcatcccaccgtattttttcttgataacttcgacacgctttagttcctgcctggtcaggccaaagcccataaaccggcaggtatgatcatttttcaaaatgcaatagcacatccgcttccagctggggatgtccttggtgctcttaatgtcgtcagtatgatcaggaattttaccgatgaaaaccacacgggattttttgtccagggtatagttggaaacaccattgcgccggatctgatatcctttttcctccagttcctgaatggcctgttccggcagcccgccgccggtttcatgccaaaattggatggaggtcttaaatttttttacatagttgttctgcaggcgtttgggcaacgtatccaaaagaaatttggtataggactgccaggtgtggccctccggcagggtgatgctccggtagcccattgctttcgttcgtccatagatggcgccgaagttcgcgccccgcactcgacccacaagtcttacccaaatctccggatcgatgatccggtacaggttcagcgcgtccttagagtagtcgttaaaaggcgatgccacacgcatctgatcaattttcagcccagctttataatacaaatcatacagttcgttataatcgtacccaaaacggcagttagccacccacacatcgctgttcgaccaatcgtataggggggaggcgcaccaaacatccttaaaccgcttggagatccagcacgcacctttgtagccatatttcatattcacaaaaccgctgtaccgctgcagggactcgaccgcccgcattcccaacaggcacactgttttgccgcggccgtgttcatcgcgataaaaccggccgaactgttttgccagatcctcctggtgcatccgataatgataatagcgaaatggtttttccaagctgatgacataagggtaaaccggcataggacgcacccaaagttcaggtttacggtcatcccaaggataccagtacatctcatagctggagagtgccgttcgggtagccataggaaggcaaatccagtatggttcaatttcaggcagcaggcgttggaaagtacgggttatatattcggttgtcaccgtatactgggcttcaaagtcttgatggaacacgccgatcacccggtccggatagtgggcacgcttgtaatctatcaggagatttaagagcaggccgctgtctttcccgccgctgaaagaaacatagatgttctcaaactcctgaaagagaaattcaaaacgctcctgcagcgcttcgtatacattttgttgtaggtattcccgctgcatcctttcctccacctcgtcgttttgattcgccggttccagcgtatcatctattatagcatgctttttctggttgacaatcctgaatttctatgagaacatcatgctcccatatgtcgcgcattttcgctctgccgcaaacggaagttatttaccatctgcttcaagctccccgcctgactggccagatgctgacttagccgagagttctggtcggccgcgtctgtattggttcgaacccctgcagatatctggccgacttcgtgtgtaatatgtgcaatcgcttccgtctgtctgcctactgtcccggacgcctgccgcagatgcccaacagacccgctggacaatgtccccacttcatgcatggatttgagcatctggcccataagaaggctgccctcatggatggactatatagaattctcaatcagttccttggatacccttaccgcctcatccgatttggccgccaaactgcgaacaacatcttcagccaccacagaaaaactctttcccgcggcgcctgcattgtcagcatctaccgctgcgttgagcgccaaaatattggtttggaatgcaatgctatcaatcgtcgcaataatttttccgatctcctgagaagacgtgacaacgttattcatcacggcgtctacctgttccatctgcgcatctgccagtctcggccgcgctgttgatagcgttggcggtcagcagtgtggatatcccgcagatctgcaaactgcttctctactactgactctgtggagccagtgtagaagtaggtaatcgtgcgcatgaagaaccacttgctgatgcatttttccaactgagaagcgtcaagtttatagtcgtacttaacaatcagatagagcacataactaaaaacaactgcattggccgaggcaatccgcttctcactgatgtatcccgcttccgccacgatattgacgaaagaatgccgatggttcaaattcatgacttttatggaaaattgcaaaaccgtaaccattttttctgccaccactaccgatcccccaattatctacctaaatacttactccgatgggagtcggcaggtgtttaaggccgcccaagctgccggctgtccgccgttcattttagtggcaattagcgatttggactggaccggcatatggccccttgggacggtccggaggcatttaagaacgggaaacccttttccggaggagcggacgactacctgcggctgctggtagaggaaatcttgccgaaggtagaaaaacagctctctagccctccagcgttgcgagggatcatgggatactccctggctggcctattcggcctttacaccatttaccagacggacgagttctcctggaggggcatgtctggctccttgtggttttctggattcaaggaatatattttctcccgcagtcccaagcgtcggctggactgcatgtatttctccctggggaacaaggaggccaagccccgctgttcctgctggatgtgccgcaggaagtcgtatgatgaaactcaggtccgggataagcgggcggcaattgtacgtttggatgagcaacagcgagttgctttgcttttctctcccgccatggtacaatctaagcaaggtggtgattaacatggataccaaagagattcttttgaaactgcgcaccacaaatggattatctcaggatcagcttgcggaaaaggtccatgtgacccggcaagcggtctcccgttgggagaccggcgaaacggtgccaaacacggaaacactaaaattgctttccaagctgttcgacgtttccatcaataccttactggattcgcccagacagctaatctgccaatgctgtggtatgccattggaggataccagcatcagcaaagagctggatggcgcattcaacgaggagtactgcaaatggtgctacgccgatgggaaattcgtttatacgaacctcgaggagctgctggattttctggagggtcatatgtccagcgaacaatggcccccggaacaggtcagggcttacttcacaacccagctgccaaaactgaaccactggaagccgtttgagacatgactataccctctgaaatctatgatttcagagggtatagcctttgtttattgttggaaaaagactggtaggcttaagattaggttactcatttattaaagtgcagaagtttaactttgttgccaatatcaaatattatcaattatttcgcaacacagtcaacaacggatattcaatgacccttattatttctccggcctgcttaacaagagggacgccagcccaaatagatgcccggctttattttacagctcactttgcagatacaccatatccgccctttttcagaaaccgcttcaaagcggcggcgtccatcagattcaccgtcacgaactttccctgataaaataccgcccagttgttgaatgcaccaggcaaggttttggctttttccagagtatccaccagaatgagggtataaggcgcccgcatctcttggcaggtcttgcgtaccaattccacactctgatggatatagggacactggggctgtaatagatggtcaatttttggcccgctatctccagccgcttggcgttttctgtaaaccaaggcttcgtcccgtcgaaggaaagaaccagcagccgatacccatccggagtagtatccaccgtttcaaacccatatttctctgcaaaggcctggcccgagagccaggccttctgcgtttttgcgcccaacatacatacaccggctttttccctggctttggcgttggccaaacagtactccatcaactgtctgccgtagcccttcccttgcccttgaattcgccggtgacccataagcagtagatgtaaagatagtgctctccctccaccggcatccaagcggtttacaacggagcgtacttgataaaaaccacgcccttggtaaaaccacgcccttggtgtccagtttgcggaatacatggccttcttccagccgctcgttgagccaagaccgcttggactccacaccgggatggggtttcttgctgcggatgatacagcataggtgctcctgcatcagattttctacagttagattgataaattgattgctcaccgcttttcatacaccagatccacgatcccgttgtaatgctgcgctctcaccagcttcagcagcagttcctgcccctgttctgcaaacagccgcacgcctttgcccagtactgtggggattactgacagccacagtttatcgatgcggccttctttcaatagctgcccagccacagccgcaccgccgcagatccagatattgccctcccgctctgtcttcagcttgtccgccaggactgtgagttttccattccagaagcagatgctctcccggtcttgctcctgccggtgtgttaccacatagcaggggaggcccgggtagggccagctttcccaaaccagttccgtgatgatctgatgataggtggtccaacccatgacgatggtatccaccgtctcgtaaaatgccgggtaactgccgggggcacccggttcactgccgtcaccgcccagccagcccacgccgccctgttcgtctgcaatatatccatccacgctcatggcaagatacaaaacgatctttcccatatcattcagctcctttgccactattgtacccggtgggcgcaaaaagaacaagatggaaagaaacatgacagaccgttgtctggtttctatgctataatataaataaatgcagggaaggcggtggaatgacatgaaaccggaccggctcatcggtattttgtccatcctgcttcagcgggagaaggtcaccgccccggagctggcggagcaatttgaagtatcccacaggaccgtccatagggacatagaaaccctgtgcctatctccacagcccagggagctggcggcatctccatccagaaggactatcgggtggaccgtaccgtgctcaccgtcccggaaatgcaggccatcctgacgggtctgggcagtctggacagcgtcagcggcacacggcgttatacccggctgatggaaaagctgtccgccgggacgggcggattggcgcctggcggcgcccacgtgcttatcgatctctcctcttggtataaaactagcttgccgccgaaaatggagctaatccagagagctattgaacagcacctcaccatccaatttacctatttctcgcctaaagaggaatctgtgcggaacatcgaaccctatacctggtattccactggtccgactggtatgtgtggggctggtgccaaatacgaaaggatttccgtctctttaagctaaaccgcataacggaactcgcttcccacaagccctttgaccctcgctgcgcacccctgcccgatctggtccccgagcggattttcccagctaaataccgggtgaaggccctctttgatccggcctgtcgctggcggctggtggaggagtacggcgaggacagcttcacggtggaatcaggcggcagactgcgcttcactggagattttcctgacgcggacagcgtgctcagatggattttgtctttcgcagacagggcggagctgctggaaccggaggaactgcgggagcggcttaggaatttggccgaaacattggccggccgttacaggaggaattgatatggcatctcatccggattttgtgaactatgtggccgaacagttgagggaggccggaaccatccgcagccgcaagatgtttggagaatacggactttactgcggcgatgtgttcttcgctgtcatctgtgacgatcaacttttcgtaaagatcaccccgcaaggggaagcggcgtaccccgatttgcccaaggcgccgccctataagggagccaaagactcctttttagtggaggatgtggaggaccgggagcggatgacggaactggttcgcatcacttgtggggcactgaaaagcaaatcaaaaaaacggcagaaatgaccatgcctcttgactcaagcaaagagagtacagagtgttctggacgccgcttaacacgtccggctgcgaagctgccggcgccgtaaaagaaaacaaaagcatacaaccatgtccagtatccattgcaggccgttcttctttacattacaatgaggacaaaaaagccaagaatcagacgcctatggcaaaaagcgctgcaccgcatgctttttccctctgagagaaagctccgccgccttgctgctgaccgtcgtatcaatgtacagtttccaggcgggcgcctccagaatatctctggcggccgcgcattctgcaatcagctctctgagccgttcgggagcggcctgctttgcctgaaacattgcctcaaagtatttttggtattgcgccaatgtaagcggaataatgttcagacgctgcttttcatcccccttggcataccagacgccatgccggaacgtttccgcggtatttgtatcaatccttatggcgatgaacagcccatatacaggtttattgtatttcaggacggcgtccgaaacatgacgcctgaccggctcgccttccatggcctcctggcgggatgatgccgacattgtgacttccgttaaaattgtaaagtcctcaaattcacaatacagatcgcctctcccgccggctgcggctgaaacaggcaaaaaatcagaatccaatcgaaagccgcgcgcctcataaggcttattaaccatatggtcgatcgccaacgccgctctccacataatccactcgaggtaagcgggggtttcatccttgggaacttcgatgacatgatcttcatcgtattcctttctgccgcctcctttgatgagaagggtcatatagtccgatatttctttccattggcggcattgcgcatctgcatagctgatctcatccgtttgggacataatgctttcaagccgctgtcttgcaatatttatttctgcgggcgtagtaaatggcaggtctgaaatgtcaaaaacaatgtggcgggcattcatctgttttaccagatcatcaagcagagcctttgcaacctccatatcgtccgtcggcaatggcgcgccggcgcaaagcgtcctgtacgcatccatgatggagccgtttgccggggtgattttggcaagcttttctgctaagacatgcttggctggggcgatcataaggccgcggcccttgcgctgaaaaacgccggaaatacgaaggtatcgcatattcatgtcgctatagtctaaaaaattatccgcctttttatcatagctttttttgcgcttggcaatttcacctttgtcaaacagccgtttggccggggctgcctttctgcgctcgcgcagatcgagaatatgatcgacgacctcgttcagatcgcagctaggatttgtcgtatgtccccataatgcaaattcaagcctgctgagttgagaggagccggttctgcgctcaagctccagcataattgccaacagccacctaagcggcgaaaaaaagtggataccgtcgggcatttggaactgttcgacactcatggagcgaaggaagcattcctgaatagcaggatatgtatctgcctgcaaaaagacctttccaaatggggtaagctcgtccatgcttcccagatcagcttggttgccgtcttttttctttacctgcggataaataaaaccgtttttggagaacatcagcctccattttctggcatggctgccagactcgtcttttccgctttcattttgtataatccccttttcgttaagcagtttcataaatccgatttcatgatcgcggccatggagctttccgacataagaagaattagcaaaaactgcaaggccctcctgaattcgattggggttgcgcaaaccggtattgcctacaagccatatatcgatttttgcattcatacggctccccctgtcaatatccaacgaataagtattcctgtacggaattcctgtgcgtttttgcagagccttgattgccaaacgagtatttatagtctatgggaatcacctcgacatgctgcttgtacctggccatgattgcaaccatttcatcctgggtgggcaggctgttggaagaataggagacgatcaggatgctgtttgcaaattttttgaacaggcggtcgaacgcatccgccacgccgtttctggtggagaatggcgtcggataagatttgaatttcttggtttgcgtgtgctgttgaatttcgacatccttccaatcccttgccagaccttcaacaaagtgatacctgcgtacatattcgttatccgacagaggcgaataatacggaggatcgatatagaccagaccggcgtgctcaacacgtaaatccatggcgtccccatgccgggaacgattctgctttccattgtcaaataccgccttgtttacagcttccacggcttctaaaaattgcttcgaaagtgattttttcagatcctttcggccatcgttataccgctctccagtgtatgtaaatattccccgaggccgtttttttgtacaggcccggataagggcggtcatggcgattgcatgcttgtatggttccttgatatcggcgatattgcttctcagaatatcgatcagctcattttcttcgtctgtataatacaagccctgaaatgtcgccgcaacaaaatgatcggacggcttatgctgcatcaacaggcttttcgcttcttcgattggcagagtaaccgtattgttttcaatcatcgccttggcaaaggtagaggacatggccatatagtcgttgctgaccacagatttaccctgtgccttgaacatatatccaacaatgccggaaccagcaaacaggtcaatgaccgtatcaaatttaaactgagacgcaacggcccagatttcagacagaagcttgcttttcgaacccatgaagcgcgtgggcggatagcaggcaacctgggcgggaagcggttcggaaagcggcctgagccgcgaggcttgcttcggcgggattgttacgatcacatcttcgcctttgcgggtgttgccgttgcacgaaatatgacgctttgtttggatcacatcgattgtgaatggagcatacagctcgtggaccagcggatggtttgaatttgtcagaagcacatggcagccgcgctcatgtaaatggataaccattttggccagctcaacatgatcctcctcataaaactgttctttggtgtaccgtttgaaatcagcatattcggagatgggcagatatggaggatcgaggaatacaaaatcaccaggccgtgcatagtgctccagcacaggcaaataatcgctgcatacgatttcggcagctttcaaggcttcagctgcggcatacaagccttcccggtcacaaattttcgggtttttgtatttcccataaggcacgttgaattgtcccttcctattgacccggtacaagccgttgaagcaagttctgttaaggaaaatcgttcgcgctgctgcttcggcctcaggcagggccagccattcctgtccgcggacagaatagaatcgctccggtgtgttttcatatttctcaagataagcaatcacatcgtctacatgcccggcgacctgacggtacagattgataagctccggattgctgtctgcgatgattgcgttttccggatgcagcgcgaagaacattgcgccgccgccgaaaaacggctctatatatcgcccgtaagagtccggcaccttgggcagcagatcatttaacatctgtgttttaccgcctgcccactttaaaatgggctttgcctgaatgcctgctttctctgccaatgtgcgcacctcccttccattaactgtgccgattgtcaatttcgtgatgccgtccatatcgcattgtaatgcggcacatctttttcagatggcaggcatatgcaatccactccaacactacagtgcacactgcgataagtataccgcgctttctcatcgtttgcaaccgtttccatacaggcatgttttgtatgcttgcgttgtagcacatcccgttgttgggggcaggggagtcgcggcggtgaaaaaggcaggcgcggtcagacgcacaggcccgggctgaaaacagcccgggcctgtacggttaggaggatcacatattaagaacctgtattcacagccgcaaaacgccgtccaggcgggccttttgcccccgctccacgttaaattttcttgccgggcgacagcccgcctgcaaaaatttgccttgatcgggtacaaaatccctcgcctgtccagtatcctccgggtgtgaatacaggttctaaaagcaataacaaggaataaaatgatgaagatccttattttttgcgggagatgaacatatcaagcgtcacagcgccgatgatgagcgcgccggtggcaacctgctggaagtaagtttcgacactgagcatgttgagcgcattattgatcaggccgatgatgagcgcgccgacaatgacatttggaattttgcccttgccgccgaagaaactggtgccgccgatgatcgccgccgcgatggcaaaggtttcatggcccgagccggccatcggttcggcagagccgagacgggcgatcatgacgacgccgcagatgcccgcgcagatgccggagatgatgtgaaccagcagggtatgcaggcggacgttgatgccggaaaaccaggcggcttccttgttgccgccgagcgcgtagaagttgcggcccattttgcttttggtggtgacgaaccacaaaatcgcagctaccagcagcgcccacaccacaggcatgggaattttgccgccgatcatgccgccgaaggctgttttaaagctctggggaaagccaaagatgggctttgcatcggaaatgatcattgtgacgccgcgaaatatagactgcgtacccagggtaatgatgaacggatgcagcttggtgaagttgatcagcgcgccgttgatcgcgcccagcagcgcgccgacgccgacgccgcccaacagcacggccaggccgaacggcatgcccgccaccatcatttttgcagtgacaacaccggaaagcgcgagcaccgagccgaccgacaggtcaataccggcaatcaaaatcgcaaagaactcgccgcaggcgatcagcatcgtcgttgcgctctgggtgagaatctgtaccaggttgcccggcgacaaaaactgcggcggcgcaaaaacggaggtcaccaggatcataaaaacgaagatcataagcgtgccgatacgttcccagtaataggcgaaatttttcttttccatcgtgttcctccttatgttgcggcaagcataattttttcttccgtagcttcccttgcgtcaaaaacggctttgatttttccgccgccgaacaccacgatccggtcacagacagaaagcagctccggcagctcggaggaaaccatcagaatgcccttgccctcattggccagatcgcgcatgatttgataaatctcgtttttcgcgccgacgtcaatgccgcgggtcggctcatcaaagatgagcaggcgggcgtccgcggccagccatttgccaatgatcgctttttgctgattgccgccggaaagcgtggtgatcatctgcgtcacactggtgcatttgacccgcatttttttgctgaactgttcggcaagcgcaatctcgcgtttctgattggtaagaccccatgtgccttccagccgcgactgcttgagagaacgggcgacggcgatgttgcgccagatctcaaaattgtgcataaagccggtttcacgccggttttcggtgatcataccgataccgtccttgatggagtgataggggctgcgcacaaaaatgcgccggccgtccagccaaatttctccagactgcatccgctccgctccgaagatcacattcatcagctccgtgcgtcccgcgccgaccagaccggcaaagcccaggatttcgccctcgcgcagagtaaagctcacatcgtttactctgcggtcgcggcggacgatgttttttgcctcaaagatcaccttgtccttaacatgggacatctcacggttaaagtaattatttttcagctcccgtccgaccatcatggagacgatttcctcgtcggaagcaacatcttcaatatttttggtggcgaccgtccgcccgtccttgagcacggtgatccgatcgccgatctcacgcagctcccgcatcttatgcgagatataaacaatacccacgccgctttccttgaggctgcggataatcttaaacaggttttccacctcatccagattgagcgaggaggtaggctcgtccatgatcagcacctttgcgttcgcggccagcgcctttgcgatttcaacgagctgcttttgtgaaatagagagcgtttccaccatagcggtgggcttgaccgccaaccctacgcggtccaacagctcctgcgcccgtttgtatatatatttgtgatccaccatcggcagcacgccgaacgcttttgtgcgcggcagtttgccgacgaacaggttttccgccaccgacagctcgtcaatgacgctcaattcctgaaaaataacgctgatcccctgttccattgattcctttggggtaagccggctgtattccttgccctggatgatcatttttccctctgtcggagtgtaaacgccgctgaggattttcatcagggtcgatttgccggcgccgttctcgccgatcagcacatgaacctcgccggggtaaaggtcaaaggtgatatcgtcgagcgccacaacgccggggaacagcttcttaatatttttcatttcaatgatcttttccatagcgcgcctccctttatacgaaggcgctgttttttcttaaaaacagcgccttcgtcatgctgccgctgggggctgtttgaaaagtcggcaactccgctattttcaaacaagccctgaattgcgtttttaacaggcggtcaggccacgttttcctttgtgaccaggttggcgtcgaccagtttggatacagcttcataatccggggagccggtttcgccggccttgatggcgtccacaagaatatccagacaggttgcgccgatcgctgcggggtcctggcagacggcgaccatattgccggccttgatcgcctccttggtttcatcggaagcgtcggtgccgaccagaaggatcttgccggtgtttccggtgttggcaatcgcctgcataacgccgagcgccatggtgtcgttggctacaaagaacgcgttcaggtcaggcgtttttgtgatgatgttggtggcgacatcgagcgccttttggcggtcccaatctgccggctgcacatcgacaacctgatacttgccggaaccgtcggcctccagcgtctctttgcagccgtcgcggcgaagctcgccggacaggtcgccggcgcggccctcgatgatggcgaccttgccgccgtcgggaagctgttccatgatatactgagcgccgattgcgccaaccttgtggttatcgctcgtcgcaaagccgaccacatagccgccggcctccttgagcgcgtcctcatcgatcttcgcatcgatgttcaccacaggcatccccttttgattggccgccacaacggcggaaatcaggttggtcgctgtgatcggcgcgacgcccagaccgtcgtaggagccgctgttgatggcgtcctcgcactttttaagctggccgtcgatgtcagtttcagcgtcgacagcgaaaatatccgctgtcacgccgagcttttcggcctccgcctggatgccgtccgccatatcgacccaaaacgggttggacaaagtttttagtaccatggcgacgcggatttcgtcgcccgccggtgtggacgctgcctcggacgattctgccggagccggcgcggacgctgtcggggaagcgggcgcagagcctgcgccggaagcggatgaggccgaggatgaggcgccgccgcagccggccagagcgcccatcgccaatgtggcggccaggatcagggatatcgcttttttcatttctgattcctccttgaaattctgcggttgtttacatggttgataacgaaaacctgtttggtttttgcttcatttttcctggcgggaaagggccgtgcatcgatgcatcagttcccggttggattggtaaagcgcgcggaaaagctccctgtattctgcatagcgggctgttccctttaaatccggaacggccggcgtatcgttccagcggatgactgtgtcgcaggcctgctgccagctttcgtacacgcccgcgccgacgcctgcgcagatggcggcgccaacgcccgcctgctcgagcattttggaggtataaacctctttgccgaagatatccgcctgcatttgcagccatggcgcgctgcgcgcgccgccgccggaggcaatcacgcgccggcagctctggccgagctgctcataaagctccaggcagtcgcgcagggagaacaccaccccttccatcacggcgcgcatcaggtgcgcgcggctatgcttgagggtcagcccaaagaacatgccgcgggccagcgggtccatgtgcggcgtgcgttcgccggacagataaggcagatagatcagcccatcgctgccgcggggaaccgcttccacctgcgtgtccatctcgcgatagggcataccgcccagcaccgtgtcccgcagccagcgcaacgaaagccctccgcaaagggtcgcgcccatgaaataccagctgtcctgctgaaagttattgaaggtgtgcgcacgcagctgcttatcataaatcgcagaggcgatgggcgcgaatacctgtgcgccggtgccgatggtgacggatacctgtcctggcgcgatgatcccgttgccgattgcctgcatcacctgatccgcgccgccatggaatacttttgtgccggctttcaggccggtttctgcggacgccgcggctgtgacctcgccagcaaagtcctgcgggagataaattttaggataaagcgagcggcgcagccccagtgtccgaatcaattcgtccgaccatgccgcctggcgaacgttcagggcgagcgtacccgccgcgtcggtcacgtcggttgaaagacagcccgtcagccggtagcgcagataatccttgggcagcaaaaccgtctcggttttctcataaagcgccggctcatgttttttcatccacagcagggatgcagtctgaaatccggcggcgatctggttgcaggtgatttcgccaagccgttcgtttccgagcagccggcggatatcctccacctcgtccacggaacgggcgtcgcaccagatgatcgctttgcgcacaggctggccctgccggtcgagcgggacaagtccgtgcatttgtccggagaagccgacgccgtcgatgtcgtctggcgaaacggccgcctgagccagcgcgcctcggatcgtcgcaaccgctgcctgccaccagaccacgggatcctgttccgcccagccctcccgggggatgtcaaatgtatattcctgctggcagatagcggccagcttgccgtgatgatccatcaacacggtttttacactggaggtgcccaggtccactccaagcagatatgccatatcttcacctccgagcgggcttacttcatcagctctttgacaaacttgagagattttttcaggttttcatgacgcgcctcttttgatacatccgcatccaggtcgcgccagatacgcagatcgttgccgacagggccgcccgccgctacaaacggctccaaaacgatgcgtccctgataattgatatccttgagcgcctgagcaatctgcgcccaggggatgttgccgccgcagccaggcaggcggcggttggcctcgctcatgtggatatgcgcgagcaacgggcctgcgctgcggatggcgtcggggatggaatcctcctcaatgttggcgtggaacacgtcgagcaacagctttgcgttggggtggccgatatccgctatgaactgcctaccctccgccacggtattgacaatgaactgttcaaaccggttgacaagttcgatagcgtaaaccatacccgcatcagcggcaaaggggatcacctgccggacagattcgacgccgcgtttccaacagtcccgcttgtactgcggggtaatctcgctgtcatagagatagggccaccaggagtacaggatgcccgagagtattttgccgcccatatactcggcggcttcgatcatgcgcttggaataatcaataccggcctgacggactttcgggtcgggagaggccatatccttggacttgggaaatccgatgcagaagctcatttcaacgccgtaatcgctggcgcattgtttaagctcattcatcttgtccttttccagattggtcataaaatcgggcggagtgacctccaggtcgtcaaagccggcgtcggccgccagccggattcgttcgcacatgtccaccttccactcattgccccaatacgcataatggattccgaattgattcatacggtacgcctcctgtcatttatttcaaagcgacaagctcttttgccagtccggcgattgccggcgcgtccatgccgaattttttcaggatatagggcacgtccgccgtctcgccggtcacatcgcgaaagccgattcgtccaaatggcacggccagacggcgctcggccagcacctctgcgactgcggaacccagtccgttataaacgctgtggttttccgcggtgagcaccgcgccggtttcccgggcggcggcggtgacagcctcggcgtcgagcggcttgattgtgaacagatcgatcacacgggcgctgatgcccgcgtcctccagcagctcggccgccttgagcgcctccggaaccatcacgggaccctccgcgatgatggcgacgtcgctgcccatccggacggtatgcgcttttcccagggtgaaggcggtcccgtccggataaattttcaggttcgttttccggtaaaggcggatgtaactgacgccaggcgcctgaatgatctgcggcaggatgctgcgaagcatcgtctcatccgtgggatcgacgatcgttgttccggcgagcgaacgcaggatgccgatatcctccagcgccatatgcgaaccgccgtttgcggtgttgcaggcgccagggtcggtgccgatgatttttatattctgcccggcatagacgccggacatgaaaatttgatcggctacacggcgcgatgcgaaacaggcaaaggaatgcgcaaccggaatcatccccacggcggaaagcccgcccgcaacgccgatcatattgctttccgcgattccgcagttgaaaatccggttgggatatcggtccgcaaattgatgaaaggccgacgcattcatcagatccgcgtccagcagcacaatccggccgtcctgttcggccagctgcatgagcacctggctgttgacttcgcgcagcagcaggctgctttttgcaaattccatatcagcacacctcctgcagcttcgcctgcaaagccgaaatttgcgcgcccaattccttttttgcggccgcggcctgttccggcgtaatcggaatatggtggatgcctgtacggccctccgtgacgctccagcccttgcccttgactgtgtcgagcacaatcatcgaggggaccccggcgcggcttttggcatcttcgatcgcgtcgtgaatggcggatacgtcatgtccgtccacctcaaccgcgtgccagccgaaatcctcgaatttacggcgcagatctcccaacgctaaaatttcatccgtatagccgtcgagctgctggcggttgagatctacaaatgcaatcagatggtccagcttttgttgggctgcaaagagcgccatctcccatacctgaccttcgtcgcattcgccgtcgcccaaaatcagataggtataggcgtcgtttttgcgcatcttcagccccagcgccatccctgcggcaagagaagcgccctgccccagagagcctgtactcatgtcgatgcctggcgtatcgtgcatattgcaatggctgggcagtgtcgagccgggtttgttaagggtgctcaacagctcctttgggaaaaacccctcaagcgccagcgccgcgtagagtatggggccgcagtggccttttgaaaggacgatgcggtcgcgtccgtcccagtccggttcagccggacggtaacgcgcttggtcgccgtaaaggacggcaaccagttcggctgcagagagcaccccgcccacatgaccggaaccgcaggacgccatcgaaaggatactttccaggcgcagctgcgcggcaaaaagattgagttcattccgtttatcttctttcaaagcagagcctcctgaacattaacattcatcaataaaaatgagtcctccggggaaatggttgttgttttgtgtcgtttttgattgttttctgttctttgttccatatcatatcattggacgcgataaaagtcaacaagtttagctggtgatccctctcgttttataggaatatacacaattgtcgattgttttttgttgcttttttatattgattgttatcgtattctgttatataataatcttgaacagtactgcattcctgttagcggaatgcggatgaagaaaccgcgccaggttatctatctgctgccatgaggtgcgctttacaaatcaatatgcgggcaaaatgggcaggtcccggcgcggcggttctcattgcgccggccaggggccgccgcacgctgaaaagccccggcctgaaaacgcttgcggctttgtcgtgcgcacagtataatagaaaaaatggttcattttgtctgtgaaggagggtgcgctttggaggagcggagacaaacggtatttgctgaggaacgtaagcagcagattttggagctgatcagtaaaaatcagaaaattgtcgtaccggagctgtgcaattatttcggggtatcgccatccaccatccgcaacgatctgcgtgtgttacaggaaaacgggctgatcacccgcacacatgggggggcgatccgaaacagcaaagtaagcctggaaccgccgccggtcacaaagcagacacagatgcttcgccaaaaggaagcgatcgcgagggctgcggtcgatttagtggacgatggggatatcattgcgatcggatcggggaccactaccctggaatttgcaagaaagctcattcacaaggaaaagcttacggttgtgctcaacgacatccggcttgcttccttcttggaggagcacaccaattttacgcttttcatgctgggaggcgtgctgcgcaatggcttccattatgtgaacacagcaggtacgccgctgccgcgggtcagcctggataagctgttttttacctgcaacggactgaatgctgcgatgggcgcgactgtgccggattttcatttggccgccaatgtagctgccatcctggagcgcagctcccaggccgtgctgctttgcgacagcagcaagctgggcagcgtgacctttgcccaaatcgctcctttggatcaattggataccattgtgattgacagtgatgccgaccccgacgaccttcgggagctggaggcgcagggagccgagctgattgtcgcaccggtggaatagtttaaaaaccatattcatggagggaaccagtatgacgaaccaggaaattttaaaacacatcgaccatacgcagctaaaagcctttgcgacctggcaggatattcagaagctttgcgatgaagcggcccaatatcatacggcgtcggtctgcgtgccgccctgttatatcaagcgtatccatgacgcctatggcggacgagtgaatatctgcacagtgattgggttccctctcggctacagcgtcacctccgcgaaggtggaggaagcccgcgccgcgctcgcagacggcgctaatgaaatcgatatggtcatcaatatttccgacgccaaaaacggccgcttcgaggccattctggaggagattaaagccgtcaaggaggccgtcggggatcatattctcaaggtgattattgaaacctgttacctgaccgagcaggaaaagatcaagctttgcgaggtcgtgacggcgtcgggcgccgactatatcaaaacctccacaggttttggaaccggcggcgcgacgctggaggatatccgcctgttcaaggctcatatcggaccgcatgtcaaaatgaaggccgccggcggcgttaagaatgcggaggacttaaaagcgtttttggcggagggctgcgagcgcatcggaacaagctccgccgtctcgttgctcaccggcgggcaggcaggcagctactagggcttgtttgaaaatagacggcaattttaatttctcaaacaaacctttgaacaagatgttcaaaaggaggaacctggatgcggatcaagggtattgaccatgtgaccatcaatttaaaagatgttgcgcgatcgctgtggttttacggggagctgctgggatttgagcgcctgccggatgttgatatgggcgaccatcttctgcggtattttgccctgccgggcggcgggcgtttggagctgaccgaataccggtatgaaacggctgactgcggcgatacggcaacggacaagggccgggcgcgccatctggcctttgaagtggaggatgtgtacgcacttgagaaaaagctcacggatgcgggatatctctttcatgtgccggtaagccatgtggaaaagctgggcttttccggcgggctgacgcgcgatccaaacggatttgaactggagtttctccagtacgattaaccaatcaaaaaaggagcgggctggcagcccgctccttttaatgggactggagacgcaatagaggtcagggacggccgcctgaacaaaaaacatagtataaaaagcatcggaaggccagccggccttccgatgctttttgattaggagcgcaggcgaggcgcatccgctctgcttttgattatcgtcacgtgtcaggaagcggtgcgcgtcttgttgggtacggtgggtcttgtctcggaattgcgtttggaggagaaataaacccgcagagaattgacgacgatgatgacgcctagaaccatcagcaaaagggcgatgatcagttgcagcccttcaacaagaaagaccgcgtttccggcggaaaaagctttgaccagcccgaccgtgcgctggacaagcgcggtcgcagtgacgcagagcatgataaccagcggtggaaagagcattttgttgctgcgtccggtgactttcatgaacacgcagagcgtcacaagcaccagtgcggaaaggagctggttggctgaaccaaacagcggccagatattggaataaccgatgcgcgtcagaacaaagctgaggacgagggtgagcacggttgaaaaatattttccgcacagcagcctgcgccagggggcggcgtttgccatgtcgtcaacgctgaacagctcctgaaagctcatccggccgatacgcgccacagcgtccaggctggtcagcgccagcgcggagacgcacatggtcataaagcactgggcgatatagagcgggacgccgaacatttcaaagaacccagccacgccgtttgagaagatctgaaacggtgtccctgccgcgggcgttccgtcagcggccgccgcggcgcccgcgacacacagcgccagcaccgccagcaggctttccagcaccatcgcgccgtaaccgaccttaagcatatcgcgttcatttgaaacggtcttggaggaggtcccggaggaaacaaggctgtgaaagccggaaaccgcaccgcaggccaccgttacaaacaggatcgggaacaaattgccaaggctgtcgttgtggaaccctgtaaaaaccgggagattcatggtgggatgggcgaccagaaggcccagagccgccccggcgatcatgccgataaacatataggtggtcatggcgtcgcgcggctgcttgagaagccacatgggcagcacggcggcaaagaagatataaataaaggtgatataggtccaggcttccttgccggcgatgagcggcgtcagcataccgccggccagcgcggcggcggtgcagataagacccaggcccgtctttttccagccggtgaagtgcatccgcttttgaatcaggccgtatgccatggcgaatacgataaacagcagagagatggaaccggccgcgccgttggaacgcgcggcagcggcgagctgtgtcgcgccgccggccgtttcataggcgttgaaggtgccggcgaccatgtctgcaaaggcggcgatcaccagcagggtgaacagccagcagaacagcaggaacaatttgcgtccgagcttgccgatgtatttttcgatcagcaggcccatggatttgccttcatttttgacgctggcgtaaagcgcgccgaagtcggtgacagcgccaaaaaagatgccgccgagcaggacccagagcagcacaggcagccagccgaaagcggctgcctggatggccccggtgacagggccggcgccggcaatggaagaaaactgatggctgaaaacggtccagccgtcggtggggacatagtcctggccatcctcatgggtataggccggggtttttgctctggggtcgatgccccatttgttggcaagccagcggccgtaaagcacataggctccgaccagacagactgccgagatcaggatgataacaagcacattcatgatttttgcctcctcaatatgcgctcaacattcttctgcaaataaaaaagccttcgtctcccgcgccggaaatattaatccggtcgactgaagacgaaggcaagcctccgcgttaccacttcatttgccgccaggacggcggccgctctgccatggcttctccgctgtggagggcaccatgctcccggataacggtgggactccggcccgcggctactgaggggaaaacctgttcaccgggctgctttcaggtgatagccgccgaaaccgctgccggctcgcaccaacgccggctctctgggagcggggaacttcggacggttgtatcctggtcgctgcatttgaatgttgatttttctatactttaaatcagcagcgtgcatttgtcaatccctttcattaaattcggaaaattatgtatatttaataactaatcatataaaattttataaaatttgacagttggggtaatgacaatacgaacgttggaagcacttggaaatcacaggcattttcaaacggcgcggtatgtggtatgatcggaatggttcttgtttagccgttctgaaaggagacagccatgcggatcatcatttcgcccgccaaaaagatgcacgtggataccgacagccttgcgccggagggcctgccgcagtttctgtccgaggcgcggcggttgctgtccgcgctgcgcgccatgccggggccggccctgcaagccctttggaactgcaacgacgccatcgcagccctcaatatggagcggctgcgccatatggatctggagcgggatttgacgcccgcgattctgtcctatgagggcatccaatatcagtatatggcgccgggggtttttgaaacgggacaatttgaatttattcaggagcatctgcgcatcctctcaggcttttatgggctgctgcgcccctttgacggcgtggtcccttaccgactggagatgcaggcgcgcctggctgtcgatggccatcgggatttatacgcgttttggggggacaaattggccctggctctggcgcgggagacggactgggtgctcaatctggcttccaaagaatacagccgggccgtacaggcgcatctgccggggccggtgcgtctggttaactgtgtgttcggagaagctgtcaatggaaaagtggtggaaaaaggcacgctttgcaaaatggcccgcggtcaaatggtgcgttttattgctgaacatgcaattatgcagccggaggggctgaaagatttttgcgacctgggataccggttcgacgccgcccgttccggggcggaccgttttgtatttatcaaagagaagtgacgatttgaacgcgcgcagaaagcggcgcgtccgttgcttgatgaatctattaatttgaaaaattttactgtaaatactttgcttttattataaataattgtataataatgaaaaataacccaacaaagttaaggagggcaaagaatgaaaaaaatgatctccattttgctggcgctttccacagctattgtgatgtgcatgcctctgtgtgcggaggaaccggaatcaggcggcatcagaaacgttttttctgataatgacatttcatgtattcaaaatttattgcttgcctggttgtcaacggatgggccatccgaaaacatagacagtgtacaagtcggcgataaaatccctgcttacgaatatgtagattcatcacttgtaacatttgattctgcaagctattaccctgtttattcagatcatgagatacttggagttttggggattcacggaaacaaatcggatccgacatattccttcggttcggaatgggcgtctcaaatcgatgaatacataaagagtaatcgttcggaattttgcatcgtagtaacagaaaatcagttgttctttaagacttccgatgaagccgagctgatagaagaataccggtttgccatgccggaagtaaatgctgttgctgattcgccgtctgcagagagcatccttgccgcgcaaaacagcgatcagactgaatattattcagatcgggaaaagtacagccttgcaattccgccgcagacaagggcggcatatgtggccaacattaatgtaggcacttataaacagacacgcggtgagtgttgggcggccgccactatgctgattgggaaatttattacaaaaaataatgcctatacaccgtttgcaatttgtgataaaatgggcataggatatgatgcgggcggttcggatcaagatattgtcgatgcactaaatacctgctatggcgttaaaggcacgctgcagggcgttttgaccccgaatcagatggagccccatgtgagtaaacagcgtccgggctgcataaactggctcgaggtgaaccgcagatatgggcactccacggcgttttgcggttattcaagcgattcctcggcctctcgatacggcataagaatcagtgattcaaatacgggcgcctacaaatggctctacaaaaatggtcagccgtctcagaagctcgggttccaatatacatatgggggcttaacctacaattggaaatccacaattacgacctgatatgcgcgccagaccatccgttgcttttaagccgtttgcgggaggttgaatatttatgaaacggtatgcgctgataggactgctttcggttctgctgtcaatcatgctcagttttgaagcctatgcgcagacgttcgtgacgcttacctaccggggggcgacccgtgtttatggacaaaaaagaattgacgacagtaaggaaatggaatccattctgcagcttgtacagaacggacaaccgcttgaatccggtgtaaatattgatgtcagaaacggcggcccggttattgagctgctggttgaggacgagcagaacggggtcctggactttacgctctacacaatataccccggaatcccggagaatgtgggatatgaggtcactatcatattggatgacgatgccaatttctcctatgatgatttggagctttttcaggagctggccgactatatcatgcaaaatcctgtcgaaaagacaattcctgataccggcagaggaggcaggtaccggccggcacaggaaggcgcttcatagcagccgttatgagaggcgctgtttccccaaaagcgcgcccgcagcgatacgctgcgggcgcgtcctgttcttttactgcgccgacgggatggagggcagactgctcaaattgttctgctcgctgccgtccgggatggatttgagatattccgtgtcgccccggtgcgcgatgccgacgccggcgatgccgccctgccgcgccagctcgaccgcctgctgcttgccaagcgtggtgtggtcggagagctgatagccgaccaccttgccgcgctgcttgaccagcgcggtgattctgcgggcgtttggagcgggggacggaatttgatcaagcgtattctgtgccagagacggaccaatttgattttgttccatcgatcattctccttttttatcattctgcgcagcctgggttcagtatgcccaaaaacagccggagtacaacggctggcagccattggattttatagaatgggaacaggaaatttttttaaatttgttttaacacagaagggtaaatgatatgacgaatgaaacaatgaggataggagatctccccgccgtgctttacggcggccaggcggaacgcgtctggctgtatgtccacggcaggtacggctgcaaggaggagggggagccgtttgcccgtatcgtctgccctgagggctggcaggttctggccattgatttaccggagcacggcgcgcgccgcggcggccccgcgggcttcgacccgtggcacgcggtcccggagctgcggtcggtattggactgggcgcgccggcgctggccctgcgcggccctgcgggcaaccagcctgggcgcctggttttccatgctggcgtttgccggccagccgcgtataggccgcgccgccgccgtccggctttttccaggcccaaagtccggtgcgctcggcgctttcgactagcgcgccgttttcatcctcccggacattgacgagcgtcacaaccccctcgtccgattccggctgctcgtcaagcagcgcaaaaatgcgctgcgcgcccgcaagccccataatgaccgcgttgagctgctgggaaacctgattgatgttacccgaaaactggcgcgtcatgctcaaaaacggcacaacgatgctgatgctgaatccaaggccgcaaatactcaaattgggcgcgccggacaaaagcagcacgccgccggtcagcgcgacaaccacatagaggatattgccgatattattgaggatcgggccgagggtatttgcgtagcggttggcaagttcagcgtccgaaaacagctcgtcattgagacggtcgaaatcggccttgctttgctcctcatggcagaataccttgacgaccttctgacctgtcatcatttcttcaacaaagccctccaccttgccgagcgcatgctgctgacggatgaagtaacgggcggagccgccgccaacatgctttgtgacaagcgccatgcagacgacgccggcgatgacgaccagcgccagccagacgctgtaatagatcatgatggcaaagatggtgattacgacaacgcccgcgctgacaagctgcgggaagctctgtgaaatcatctggcgcagcgtgtcgatatcgtttgtgtaatagctcatcacatcgccgtggttgttcgtgtcaaaatagcggatgggaagatcctgcatccggctgaacatgttttcgcgcagcttgcgcagaaagccctgcgtgataacagccataagctgtgtaaacgtcatggctgcggcaagcgacagcacataaaacacacaaaggatgccgacaagcggcagaatccgccctgcggccgcgccccaatcgccgctttgccagctcgcctcaacggccgcgatgacattctgcatgaaaaccgccggaatggagctgaccacggcgctgaacaggatgcagacaagcgtcagcggcatcatgaccggatagaagcgaaacagcgtggaaaacagccgcgcaagcgtattttttaccgggaccggcgcgcctttagttatattcatcctgatcacctgccttgttctgtgatgtatagacctcctgatagatcgggttagccgcgagaagctcctgatgcgtgccgatggcgttgatcgtgccgccgtccaggacgacgatgcggtccgcatcctccacggatgaggtgcgctgcgcgatgatgatcttggtggtttcggggatatactcccgcatcgccttgcggatcaacgcgtcggtgcgcgtatcgaccgcgctggtcgaatcgtccaggatcaggatcttaggacgcttcagcagcgcacgcgcgatacataaccgctgcttctgcccgccggagacgttggagccgccctgctcgatataggtgtcgtagccctttggaaactgcgaaataaattcatccgcctgtgcgagccggcatgcctcctttagctgctcgtcggtggcgtccgggttgccccagcgcaggttttcgctgatcgtgccggaaaaaagcacgttcttttgcagcacgacggccacctgattgcgcagcgcctccagatcatattggcgcacgtcgacgccgccgacgcgcacacagccttccgtcacgtcataaaggcgcgatatgagctggatcagcgtcgattttgaggaaccggttccgccgatgatgccgatggtttcaccggaacggatgtgcaggtcgatgtttgaaagcgccatccgcttggccgtcttggcatacttgaagctgacgccgtcaaagtcgaccgaaccgtcgcgcacctctgtcacagcctgcgggggcgaggtgagggagcttgtttccccaagcacctcggcgatacgctgcgccgattcggtggccagggtaatcatgacaaataccatggaaagcatcatcaggctgcttaaaatctggaaactgtatgtcagcagggcggaaaactgccccacatcgagcgccagaccgcgcgttgtgatgatcgtataggaaccgaacgacagcacgaagatcatcaccgtatacaggcaaaactgcatgagcggattgttgaacgccaggatgcgctcggcacgcgtaaagtcggcgcagacgtcgccggcggctgcggaaaacttttgcttttcataatcctcgcgcacataggatttgacgacgcgcatgccctggatattttcctgtacggagttgttgagcgcgtcgtattttttaaaaaccctgcggaaaagcggcatgaccatacgaatgatggtgaacaggccgattccgagcagaggcgctacaatcaggaaaatgagcgccatgcgcccgcccatgataaaagccatgatgaatgaaaacagaagcatcagagggctgcgcacggcgatacggataatcatcatataggccatctggacattggtgatatccgtggtcagccgcgtgacgagcgacgaggatgaaaagcggtcgatgttttcaaaggaataggattgtatctggtaaaacatatccttgcgcaggttgcgcgcaaagccgcaggacgccttggcgcatgcattgcccgccagcacgccgaacaacagcgacaggccggccatagcgatcagcgcggctccgaagccggcgattacgcccataccgcatcccgccttgatctggttgacaagctgtgcaatgacaaacgggatgacgcattccatcaccacctccagcgaaacaaaaactggagaaagaatggaaggccgtttgaattcgcggatactttttataagttgccgatacatggatttcccccttctttgagtagtatatggatgcgccgcaggcatccatggcgctgacggctgctgctgcttttccaaatcaagttcatctcgaaagctgctgcgcagacagccgccattttttaattcagaaaagcaaaacgcgtaagtcccgcgaatttggacttacgcatttccagcccgctgcattgcaacggcgcgctgcaagcggccgcaccgcttgccctttaagatattatagcggacgcgggggtttcatgtcaagcgtccgtttggatacgggcgtgaaaacggggtacataggaaatatgcaggggcagccacctgtacggccggcccatccgtaaaatatggaaaagggcgcgcccatacatgtggacgcgccctgccgggattacatcagattatcaaacaccgcatcaatcttgatcttgagcaactgaagcttgcgttgcagaagctggttttcctccttgagctgatggatgtacagctgacgcctgattttcattttcaaaagctgcgcgtggattggcttttgaataaaatcctcggcgccatgcgtaaagccctcgacttcaaaatccatcccctccatgcttgaaagaaagatgacagggatatccgccagcttggggatttctttaagcgccttgagtacgtccatcccgcttgtgcctggcatgaccatgtcgagcagaatcaattcaggcggctggtgatcctggagatatccaagggcctgcaggcccgactgcatggtggcaacctcatattctgattcaagcagcgccttggcgatcgcgaggctggttgtgtcatcatcgattatcattatttttttcatgaccatttctcccccacatacgcgatataaactcgtttaatatttagaagcctgcattgatgcgcctgaaagacggcgcggtcaaatggagttgcaccggggccgcggctattttgtcatatccacagcgcggcatgataaaattggccgtcagggcggcagcgggacgcgcccgagcatcgtcccgaccatagaggaaaaaataatcgcagggcgattatttttacacatacgggcgctttcccgcaaaaaagcgcccgtatggttgacatactcaccttatgaatataattccttgtttatgaatgatattcactgatcaattcaacgacccggtcatattcctcctgaatgcgcagatataattccggaagcaacgtggttttgcgctgccgcagataatcgaggcactcgctgcaaatttgattcaatccagagatgccgaggttggccgtcagccctttgagcgtgtgtacctcccgttccacatcctcaagcacgccgttctcaatcacattcacaaggcgtccatatgtggggtcctctgggaatttcagaataaattttttcagcagctcgctcatgccgccaaagcgttccagcgttgctttttcatccaccccaatgtccctgagcagttgtccaaactccatataatccaccctctcaaatatagatttgtgtcaacccctggtttaaaagctggttcaaccccttaaacagggattttatgtcaattggtttaattaaataaccgttcatcccgatctgaccggcatactcctcgtcctcctgaaaggcgttggctgtcatcgccacgatggggacggttgcggcgtcggcgcgcggaagcgcgcggattttttgcgtggcggtgacaccgtccatgaccggcatacggatatccatcaaaataacgcggtaatagccaggtgccgacgcctgaaatcgatcgacagcttcctggccgttgctggcttcgtcaacggtcaacccctgcatttccagcagcgtgcgcgcaatttccatattgatctcgttgtcctccactagcaatatccgttccccgcaaaattggtaggaatccggctcctgtgcgggcggtgcgtcctgcacggcccggctgagagcgtcgcgcacgctctcggggaacatcggtttggaaatgaaatggtccacgccggcggcacgcgcctcggattcaatctgtgcccagtcgtaggcggacataatgataacgagcgtttcaggcccgacaagctcgcgcatacggcgtgcggtttcaagcccgtccattccaggcatcttccaatcgataaacgctacgtcataattttgatttttggcgcgcgcctcgcgcagctcccgcagggtctgctcgccggacgtaacccagacagactcaagccccatgtgcagcagaatagtctgcgtatgctcgcaggtgatcacgtcgtcgtcgacgataaggacacgcagatggccgatagactcgctgtcgactaccgcaggctcaacagcctcgcccaattccagcggcagctccacaataaaccgcgaaccctttccgggttcactttccagcgagatgcggccgtccatcagcgccacgaggttctgggtgatcgtcatcccaagccccgtcccctcaaagacgcgtccgctgccggcggactcctgctcaaacggatcgaagatgcgcttttggaattccgggctgatgccgacgccggtatcagcgacctcgaaacgcacaagagtgatgtgttccttggcctttttgcgttcaatgcgcagggatacgcgcccgccctccggtgtgaatttgattgcgttgctgagcagattcatcaggatctggttgatgcgcagttcgtcgcccgtacaggtcaacggaaagttttcttcaagatagacgttgaacgcaagatgcttttgtgcggcctgctgtccgaatacggatgaaataccctggatcatgcggtgaaaattgaattcgcactgcgcaatgacaaccttgccgctttcgatcttggacatatcaagaatatcgttgatcagcgacagaagaaatttggccgatacgccgatcttttgcaggcaatcagagattttggcctcgttgccgagattggcggccgcgatggcagtcatgccgataatcgcattcatcggcgtgcggatatcgtgggacatacgcgaaataaaatcggactttgcccgattggcgtcgcgcgccagcacaagcgcgtcctgcaaggcacgtttattgcgttcgtcctcacggcgcgtttgatcgatgtcgcgcatgtacagcatgattttataactgtcataagattttgataaaaattgaatctgtatcgaataccagtggtactcgtcacttgtaaaagaggtcttgcgccggacctcaaaataaatgctcggggagctggccagccgctcagggatcgtgtccatatccatttcctgcatatactggcggcgaaaatccggatggatcaggtgctcccagcggtagtcaattacctctcgcagcgtctgcccacccgggatgcgctggattccatcctcatcacagatgatttcatggatttcatttgtaatgagatccgcttcgaacacttggtcatacaggtcacggaaggcggttgcaaaaatccggttgcgcaccagctcacggttcttggcctcacgcacctcctgaacgtcctgtatggttagcaggatatgcgtctggtcgccctcataatatgtaaaacggatgcgcttccagcggaaggcgccgtcgttgctcaggatacggcagtaaaggcggcactcctgatcggactgcttcagatgggagatcagcgtgggcagatcgagctgtcttataaattcaccgcggtcgtccggatataccgcgagctgcgcaatgcgcgcaacctgatcgggatatgcgccggcctgcgggagctgatagatggagccaagcgaacagaagcggatgacatacgtctctgtcggcacttcaatggtggcgacaaggttgtaatcctgattgaccgtaaaattacagatgcgttcgagcgactcccgttccagctcaagctgcttaatatgggtgatgtcgcgcaacataccgatcataagcacggggcggttgttttcgtagagcatattgccccggatgagaaaccagtggtattcctgtgtatacggtgtaagcatacggatttcaatatcctcgagtgtacggccgttgagcttgtcacgcatacgttcgatatagtccggatgtataaagcctgtaagttccatccggctaagataccccggctgttcaaatcgttgcgtacagcgcacgccatcctgaaagacgccctcaaaagctgtgaaaaaatcggatgagacatcatattcaaacatgatgtcgtccgtactttcgacagccgtctgatagcggattcgctcgcgttccatctcctgctggaccttgagcctttcctcaagctgcttttcgtgatcgatgttgcgcgagagtgtgatctcaagaacgtcgctgctcatagggttttccacgcggacgacccgtgtcacggtccagtggtattccccatcgtcgcctagctggcggtgctccatataaatattggtttcaccatttgcaaaccgctcaagcaactgcttgcggccaaaggtgtttttaaactgttcgcggaaatcgggatgcatggtttgcgcaccgatttcaatcagttcgtcaaagttgccctcatcgggcgcctgctttgtatcgaaccgttcgtattcaaccatgaaaaaacggtttctggtcaggttgacatagatgaccattgaataaacatacgaaatcgcctgcagcatccgccgccggccccactccagctcctgctcgcgccttgtgagcgtgtgcgggccgaccgttatgatataggccggtatcccctcggcccagagcattctggtggccgtgatatcgaccattccaccgaatggatcgttatacgataccgttgtatgcgactcccggtcgccgatggaaagcagcgggcagttggaacatgtgtcgggccacagctcgtggcagacggatccaatgcgcacagcgggcgcgaccgcccggacacggtcgttgaaataaagcatttcatgcgtatcgcgccggataacatagatgccgatgctggtgatatgatcgagaaccttttccaattgttccagatacgacatccgatcacccctgtccgatatatacaaatttattttgccgcagcgcaagccctttcgggtttggatacgcaaaacagcagcgaaaccagcggagctggttttgctggttgccctgtgcatattgtagcatattttcggaaaaaagcaatctttatgcattcttatgcaattactgcatggattgccgcgccgctgcggttgtgatacaatttataaaaaaacggcgcgccgcgcgtttttcccaaaacctgcggcgcgggggaggaatggcaatgcatcaaacggttcgcgtgttttatttcagcccgaccggcggcgtccggcgcgtggcgcgcgcactgggctgcgcgctggccaaagcgccggagtttttcgatctgtcggctccggacgtttccatgccaaaggcggacggcgagacgcccgctgtatttgccgtgccggtgttcgcgggacgcgtccccgcgcccgcgaagcggtgcgccgcatcgcgggcgcgggcgcgcctgccgtggcggttgccgtatacggcaaccgcgcgtttgaagacgctctgcttgagctgtgcgacctgctcacagcgcaggcgtttgtacctgtggcggccggcgcttttattgcggagcactccatgctgcgcacagtcgcggccggccggccggatgcgcgcgacatgcaggagattgaagctttcgcggcggcggtgcaggaaaaattggacagctgcaggcatgcggcggtatctgttccgggcagccggccgtactgcgcgggcaaaccgctcccgctgcggccacaggcttcggacagatgcgtgagctgcgggctttgcgcgcggcgctgtccggtgggcgccatcccgccggacgcgccggataagacgggggaggcgtgtattctctgtatgcgttgcgttgcagtctgcccgcgccaggcgcgtgcgctgccgcccgcgggactgatggctgtgcaggcaaagctgggcggcctgacacaggtgcggcgtgaaaatcagacatggctgtaaaagaagcggctgaaggcttctcgggattggcggtcccggggagcctttttgatgtgtagaaggttgcagcaaaatctgtgatcgctatatccaaattggttgttcgattttggtttgaaatgacgattgaataaacataatttaaaaagtagttgcacttattacgattatttgttacaatgcaattgaagtaaccaagcttgacacgggaggtgtgcgcatgcgtaagagcgtttttcaggttaacaaacgccaaaaagaggttctttcgcagctcgaacaggacggcgtggtttatgtgacgcgcctgagcgagcgtttcggcgtatcagaaatcacaattcgccgcgatctggagacgatggaacgggccaggctgcttacccgttttcatggcggcgcccgcctgccggaggagccggcagaggcggtgccgctgtttgacgagaagggccgccgcaatcttgatgaaaagattctgatcgcccgccgtgtagccgaattgatccatgaggacgatatggtatttatgaacagcggctctacggtcacgcacatccctcaatttttgcagaataaacgcgttacgatcatcacaaacaacgcacggatggcttgtgtcgattatggcgagtcggtcagccttctgctgaccggcggtatccacaacaagattacacagtcgttgacgggcgatctggccaagcgcgcgctcgaacaggtctatgcgaccgtctgcgtactcggggtgaacggtatttccgctgaggatggaataacaacctcgctttaccaggaaacggagatcaacgacgcgatgctcaaccgctgccgcggcaagcgcatcgttgcggcggacagcagcaaggtggggcgcacgctcaattttatcagcgcgccgatcgataagatcgatatgctcgtgaccaccgcccgcgccgaccctgcggagattgaaaagctcaaggcgcgcggcgtggaagtgcttgtggtgccgtgcgagccggtgggcggggaacactgcatgtaaggcggccggaccgccgcggccgcgcggggacaatcaacaaaggcgcgccggcgccatgttcgataggaaggatgcggtttaaatgagtaaaagcagcgaattgatgccgaatatcgatcggaaatggacctttgtggacaatggcgcttatgaccggatggcgtttgacacacgcgccatcgaaatcggtaacgacacggaccgttcggccgtgccgatctatgcgtcggtgacgtcgggcgccggctaccagcgccacggcgacccgtcgcgcgacgccgtctcgcgcaacatcgcgtcgcttgaggggacgcgctgcgccctgatgaccgcaagcggcgtttccgccatgacgctgccgctgctcgcgcttctgggccgcggcgaccggatcatctgccactacgatttgtacatctggacgtattttttcgtacgggaggatctgccgcgcctgtgcggcgcgcagatcgacatgatcgatatgaccgacctgaaccagcttgaggacgcgctcagtcggggaaaaacaaaaatgatcgtgctggaaacgatcgccaacccgctgatgaacgtgatcgatatcaaagcctgcgcggagctggcgcaccgctacggcgcgctggtgttggtggacaatacgttcgcgtcgccttatctctgccgtccggcggagcttggtgcggatatcgtggctgaaagcctgacaaaatatctcaacggccacggcgacgccatgggcggtgcaatctgtaccagtgacgaacagctttaccttcagttccagcggatgatgggcgtgatcggctgctgcatgagtccgttcaattcgtttttgattatgcgcggaatccagacgctgccgctgcgcatggaacgccactgcgacaacgccgaagcgattgtcgcctggctggccaagcagccgtatgtgtataacctgacgtaccccgggctggccggacatccgcagcatgcgcttgcaaaacggcagctcaagcggtttggaggcatgttggggttccagcttgcgtgtgatcatgacacgctgtacaatatagtcctgaaggagcttaggctgtttaagcactgggttagtttgggagaggcgcattcgcttatcagccccaaggatgccgaccctgaaaaggggattccggcggactttatccgcgtttcagccggactggaaaacagtggtgatctgatcgatgatttaaagcaagcattttccagggtgcattggcaataacctgggggattccttttgaatagaggcgcacatcaaaaaggcgcccgcgggcttacctgcgggcgcctttttgatgtttattttttgtaaacaatcataaatattgaaaaatatgatcaaatatttaagcgatttgaataaatgggacaataaaaacatatataatcctctaaaagtaaaaaaattagtgaaatttaattgacttttatgattgatacaaataaaatatagttaaagagatcgaatgtgattaaaaacgatcattatacgaaaagaaaatcgtgcagaaaaaggctcgtaccgttgagacaggaggaaggatcatgaaaagaaaattggcagcgttgctcgcggcgatcaccctggcatccgcgtttgttgcgtgcggcggcggcacgcagaccccggcttcacagcccggcgcgcccgcttctcaggcggcgccgctcgaaccgaccgaggcgccgacaacgaccgacgccatcaagcgcggcggcgtgctcacaacgagccgtttgggcatcacgccgctcaatcccaccaagtatatcgccatgcagggcgataagatcatcgaggggcttttcttcgacagcctggtcaacatcaatgaaaagatggaggtcgaaccgtttctggccgaatcgtggacggtctccgaggacggcctgaccatcgatatgaagctcaaggagggcgtcaaatattttgacggcacagagatgaccgctgagacggtcaaatactgttgggactggtatcttgaccccgatacagccgccaacttctatccgctgatctccgatgtgcagtcggtggatgcggtggaccaatacaacctgcgtttcaatttctcgcagccaaacgccggctttatcgagctgatgtcgtatcaggcgggctatgtgctctcccccgcgtcgattgacaagtataagcaaaccggcgatgaaaccgtctttgcgcgcgagggcggaaccggcgccttcaagctggtcgagaatgtggacggcgtgagcatcaccgccgaaaagaacccggactatcatgtgatgggcgaggacggccagccgcttccgtacctggacggcgttgtcgtcaagatcatcggcgacgaggcggtcgcagcatccaacctgatcagcggagacctcgatatgatcgacgtggtcagccagccggccgtcgtcagccagatcagcaacgcccagggctgccagatcaagatcaacgctccgcgcgaggtattccatttgtatatgaatatggagcaggagccgtttgacgatccgcttgtgcgccaggcgatgtgctacgcggtcaaccgcgacgaactcaaccaggtggtcagtatgggacaggccatccagacgccgtggctgacgctgcccgatcagtggtactacaaggacggcgagatcatcggctacgacccagccaaggcaaaggagctgctggcccaggccggctatcccgacggcgtggaggtcgagctttactacggcacttacggcgtcatgcaggctgaatgcgaactgatccaggcgcaggcgaaagaggccggcttcaatatcaagctggtcggcatggacggcgcgtccgtcaaaacgctctgggcgctccagaacaccgacgccccggccggtatgcgcctgcaaaacaacatcatccccaaatccgacccgtatacacagatggaatatatcttcggtgaaaatgcgatccagaactgttcgcgctggatcgacgcggaataccaggaactgctcaagaaagtcaaagtgacttttgaccgcgacgaggccaagacgatgctcgaccggatgcaggatatcggccttgagcagatgccgaccgtcgtattgcaggcgggaccgcgccgcagcgcgctggccgatcacacaatgggcgtctatttcgactgcgacgcgtcgatgaatttccgcgccgcatggctgaacaaataagtctgccggattgcacgcggccgcggcggccccgggccgccgcggccgcttcgctttttggcggaatgcgggggaatgagcatggtcgcttccataggcaagaaactgttatccatgataccgctcgcgctgatcgtcagcatcatcctgttcgggctgatcaacctgctgccgggcaatgcggcgatggcgattctgggcgattcgggcaacctcgagcagatcgaacagctcgaggcggagctggggctggaccagccggtttatatccagtatataaactggctcaagggcgtctgcaccggcgatctgggcacgtcgattctaaccggccagccggtgatcgaccgcatcgccgagcgtatgcccgtcaccttcgagctgatcgtcctgtcggtggtgttcgcggccgccgtcggcgtgccgctcgggattatctgcgcggtccggcgaaaccgcgcgtcggattacatattaagctccgtgtcgatcatcggcgtggcaatgcccgccttctgggtggggatgctgctgatcatgctgttttcaatcaagctgcactggctgcccgcgtccggctatacgccgttttttgaaaacccggtggaaaacctgcgctccatggcgctgcctgtatttgcgaccggcatcgcgctggcggcgacgattgtgcgccagacgcgctcggcggtgctcgatgtgctcgggcaggactacatgatgacggccaagtcgaagggcgtccgctatcggacgcagctttggcggcacgcgctcaaaaacgcgctgatccctgtgatcacggcgatctcgatgcagatcgccggcatgatcggcgggtcggtcgtcatcgagacggtctttctgctgccggggatgggcaaatcgatggtggacgccatcttccagcgcgactacccgatcgtcatgggcgaggcgcttgtgatcgcggtgtttatcatcctgttcaatacgctggtggatgtgatctatatttttgtggacccaaggatttcccgctccgggaaaaaaggcaggtgaacggcggtatgaaacgatgggaacagtttttggaatcaaacttttacaaggtctggcgcaagctgatccgccgccgcgtggcggctgcggggctgattgtctgcgcggtcattttgatactggtcgttttcggcgatctgatcagcccgtatgacccgcagcagatcaacacgatcgaggcgctccagccgccgagcgccgcccattggttcggtaccgacgagatgggccgcgacctgttttcgcgcgtgatttacggcgcgcgccttacaatggcggtcagcgttgtggcggtggccatctcgctggcggccggtacggcgctcggcctgatctccggttatgcgggcggcgcggtcgacctggtcatttccaaatttatcgaggcgctttccgccttcccgatgatcatgttcgcgctcacaatcacagcgatcctcgggccggggctgcgcaatgtcatgatcgccatcggcgtggcgtatgtgccggcgttcgcacgcattgtgcgcggcatgacgctcaccgtccgggaacgggaatacatcgaaagcgccgtatccatcgggctgaaccgggttgaaatcctgctgcggtacgtgctgccgaacgtctcgtcggtcatcatcgtgcaggcgtcgctggcggccgcgtcggccattctgtcggaggcgtcgatgagctttctcggcgtgggcgtgcaggcgccgcaggcaagctggggcgcgatgctcaaggcgggctacaattatctgtcgatggccccgtggatgagcgtttttccgggagtggcgatcgtgctggcggtgctggcgctcaactttgtcggcgacggcctgcgcgacgcgctcgacgtccgtctgaaaatggactagggggagcaaaggcatgaaagaggtgcttgtgcaggttaaaaacctgtcgacggcgtttaaaagcgaagggaagctgataaagatcatcgacgacgtcagcttcgatatctaccggggcgaggtgctcgggatcgtcggcgagtcgggttcgggcaagagcgtcacgtccaagacgatcatgcgcctgctgccggagccgcccgcgcggattctcggcgggcagatcctttttgagggcgacccggcgcaggacgtgctgcaatttaacgaaaagcagctctgccggttccgcggtgaaaaggccgcgatgatcttccaggagccgatgacctccctaaatcccgtgctgacctgcggctatcagatcagcgaggcgattttgcagcacaaggatttaagcagatcttccgcgcgtgaaaaagcgatccgcatgctcaaaaaggtgggcatccagtcgccggagacgcgctacaactgctacccgcacgagctttcgggcggtatgcgccagcgcgtgatgattgcgatggccctgtgctgcagccccgagctgctcatcgccgacgagccgacaacggcgctcgacccgacgatccaagcgcagatcctggagctgatcggcgatttgcagcgcgagacggggatgacggtcgtatatatcacgcacgatctcggcgttgtggcggaaacctgccgccgggcgatcgtcatgtatgccgggcgcgtcatggagacggccggcgtgcgcgacctgttccgcagcccggcgcacccgtacacagccgggctgatgaaggccatgccaaagctcaatgagaagtgcggccgcctttacagcattgagggcaacgtcccaaactttgcggatatgccggccggctgcgcgttccacgaccgctgcccggtccgcatggatatctgcgcgcgcgagcgccccggcgtctgcacggtgggaccggaacatacggtttgctgctggcgggcgcagaagaacgccgccggcggcgcgcgggaggtgtaaggatggaagccttgcttgaagtgaagcatttgaaaaaatactttcccattacaaagggcgtgctgaagcggacggtgggccatgtgcgcgcggtggacggcgtgagcttttttatcggcgcgggcgagacgttcggccttgtcggcgagagcggctgcgggaaaacgaccgtcggcaagatggtcatgcggctgacggacccgaacagcggcgaaatcctgttcgagggcagggatttgacaaagcttaaaaaggaggaaatccgccgcgaacgcaaaaacatccagattgtgttccaggacccgttcggttcgctcaacccgcagatgacggtcggggagctgttcatggagccgctgcgcaagcaccgctgcggcagcgggcaggaaatccgcaaacaggcggcgcagatgcttgagacggtgcgtttaagccagcgcgacgcgggcaaatatccgcacgagttttcaggcgggcagcgccagcgcatcgccatcgggcgcgcgctgatcctgcgcccgaagctgatcgtctgcgacgaaccggtttccgcgctcgacgtgtcggtccaggcgcagatactcaatctgctcaaggatttgcaggagcagtacggcgtgtcctacctgtttattgcgcacggcatggcggcggtcaagcacatctccagccgggtgggcgtcatgtacctgggcaagctggtagaggtcgcgccgtccgatgaaatctttgaacgctgtatgcatccatacacgcgggcgctgatgtcgtcgataccgatcccggacccgttttatgagaaaaaacggatcgtgctgcgcggcgaggtgccaaatccgatcgatccgccgtccggctgcaagttccacacgcgctgtgagcgcgcctgcgaacgctgcaaaacagaggaaccggcgctgcgcgaaatcacgccgggccattttgcggcctgccatttcgcgggcgaagccgccggttagatgcggggggtgaagcgatgggataccttcttgcgcttgatgccggcacctccagcatgcgcggcgggatatgggaccatacgggcgccctgttatggatgcatcaggcggcctatcgggtgcggtcggcccagggcgggcgcgtcgaacaggacccgcgaagctttctttcggcgcttgaggaaatcgccgcggccgccggcgcctgctgccgggaacacggtatcgaactggcgggcgtggggcttgcctcacagcggtcgtcgctgatcgccgtggatgaaaacggcggcgcgctgcgcgacgccatcatgtggcaggataagcgttccgagccgctgtgcgcggccgtcgacgaacggtatgatccgtatgcggtctgcggcatgcgtcccacgccggtgtataccgggccgaaaatcctgtggctgcggcagaacgaaccggacgtctttatgtccgcgtacaaattcctcggcgtccatgaatatctgctgcaccggatgaccgggcgctttgtgaccgacgaatcggtcgccagccgctcctgcatgctcgacctatacacgcgccgctggtcgccgcgactgctcgaggcgttcggcgcgccgcccgaaaagctctgtgaaatcgtgccgcccggcgcaatctgcggggagacggcgccggattttacggcgctgctcggccagccgcgtgcgctgccggtggtaagcgcgggcggcgaccagcagtgcgcggcgctcgggcttggcgtgacgcgcgcatgcgcgctttcgatcaactgcggcacaggcgcctatgtggcggcgcaggcgcaaagcccggtcctcgacccgcgcaaggatgtgatctgcaactgcttcgcgctgcccggcgcatatgtgctggaggcttcgacaatggcctccggaatggtttacgactggtttgtccatgcggtctgccaatcgacggactatcaaagcgcggacgccggcgcggcggcctctccgccgggcgcgggcggcgtgcttgcgctgccggatttaatggggcgcgggatgccggcctgggacggcgcggcgcgcggcgttttttacaacatcggttttcacacgacgcgcggcgaccttgcccgcgccgtgctggaggggctggccgcggggctgtgcgcctgcgtggagctgatgcgcgcggcgggcgtggacccggcggaggccgtctgctcgggcgggctttccaaaagcccgctgttcgtccagatcctcgcggacatgaccgggctaaagatccaaacgccgcgcgtctgtgaagctacgctgcgcggcgtctgggcgtcgtcggccgccgcgttcggttggtatgccgacatgcgggaggcagccggcgcgccgccggcgcaggcgcgctatcgccccgacggcgcgactggagccgtttacaaaaaagcgaacgaggcgcgccggctcctgtacgacgcgctcgacaccaggcggcttggctccctgcttggaagcgtgtgcggctgatacgtggccgcgccgatgaaaaaagatggtatggaggaattgtcaatgggcaaagtggatgaagtcaccagggaatcctggattttaagcacctttccggagtggggcacctggctcaacgaggagatcgacgaggaacaggtggaaaaaggcacgttcgcgatgtggtggctcggctgcacaggggtgtggatcaaaacggaaaaagcgacgaatatctgcgtcgacgtttggtgcgggaccggcaagcgcacaaggaaaaagaaacggatcgacccgcagcaccagatggcgcgcatgtccggcggcaaaaagctccagccgaacctgcgcgcggtgcccgccgtattcgatcccttcgccatcacatcggtcgacgcggtgctctccacacacgatcacaacgaccacatggacatcaacgtatgcgcggcggtgcttaaaaactgtaggcccgacgttccgttcatcggtccgcgcgccgttgtcgacaagctggtcggatggggcgtgcccgcgtcgcgctgcgtcgtcgtgaagcccggcgatacgctcacagtcggggacctgcgcgtcacggcggttgaatcgttcgaccgcacagccctgatcaccgcgccgcccgacggcgacctatacggcatcacgctcgattttatggataaaaaggctgttaattacgtcatcgagacgcccgccggcaccatctatcacagcggcgattcccactattccaactactacgccaagcacggcaacgactatcggatcgacgtcgcgttcggctcgttcggcgagaacccgcgcggcattaccgacaagatgaccgcgagcgacatcctgcgcatggccgaggctctgcgcgcaagggtggtcatcccgctgcaccacgatatctggacgaacttccaggcggacccgatggagatcctcgacctgtacgaccgcaaaaaggatctgctgcaatacgcgtttacccccttcatctggcaggtgggcggcaagttcatctggccgggcgacgccgataaacgccgctatcattatccgcgcggctttgacgactgctttgccgtgccgatcaacataccctacaacagctttttataagcggaggcgcgcaatgaggtttgaaaaaaaggcgctggcggcactggagcggtgctatgccgtcagcacgcttttcatccgggggaaaaagcattttgtcgtcgcctccgaaaaggattttccgtgcctgctgctcgacgagcacggcgcgtttgtcgaacaggtctggccgggcgagccgggcgggaccatgtcgctggtgccctcggagacaggcgacggcagctttctggcgacgtggcagttttattcgcccaacgattccaaacaggcgcggattgtccgcgccgcgccgcgcccgggcggcggatgggcggtcgcgacgctcgcgcgcctgccgcatgtccaccgcttcgatgtgctccggcgcggcggcgtgtcctatatgatcgcctgcaccatctgctctggacgcgattataaggacgattggagccacccgggcaaggtgtatgcctgcgcgctgccggacgatctgtccgctgccggccaggcgcatccgctggcgtttgagacgctttccgaggggatgctcaaaaatcacggctacctgcgctgtcataaaaatggcgcgcctgcagcgcttgtgacgtgcgaaagcggcgtctaccgctatacgccgccagcggcgccaggcggcgcgtgggaggtggagcatctgcttgaggagccggtcagcgacgtctgcctggtcgattttgacggcgacggcgtggaggaaatggttacgatcgggccgtttcacggcgacacgcttcaaatttataagcgcgacggaggcgtgtatcgcaagatctatacccatccgaagccgctgccgttcgcgcacgctatctggggcgggctgctctgcggccggccggccgcggtcatcggctgccgcggcggcgcgcgggagctttgttgttttacaggctcggaatccgacggctttcactgccaggtgatcgacagcggtacaggcgccgccaatgtcctgcacgacacagtggacggccgggaggttctcttggccgccaatcgcgagatcggagaggtggcgctttacacagccgccggttagcgggagagacggcaaggccccgcgggaatactatgtgtattcccgcggggccttgccgtgccgccagctttgtcacaggaccaacggcgagcctgtctggcggcgcgggatacccgcgcggaaaaactcccgcgcgatctccagtgcgcactgttccggctcggtcagctcgctttcgcggtaaagcgcatagacgcccacttcgttcttttcggcaagccctgtcagtgggatcacacgcagcgcgcctgatgctgcgttctcatcgcggataaagttgatgccggctaaaaaagcgatcaaatcgctgttgagcacggagagcttgacaagctcgttgcttgtgaaggacgcgacccgggggacgctgcggaacgcctgggcaaaaacagagttgaccgaatttgtaaaataatagtgcggcgtcacctgacgttcgtcagcaagctctgcgatgtcaacgctctcgcggtccgcatatttggaatgcgcgcttacgcacagataaaagctgtccgaatataaaagctccatcgtgatgccgtttgtacgggcgatctgctccgcctgcttcaattcactgctttcccagtggccgattgccagattggcgattccttcaaacatgctggccagcattttggtgcgcatcggttcatgaaagatcagagccgactgagggctgcgtatctgcatctgctgtgtaagaaagacgctcagattgctgttggctgaggtggacgccagaatatggactgtttgctcccgcacacttgcctcgcgttcaatctctgtcatttcaccatacaagtcaatgatctttttggccagcccgagcaccttttcgccctcctgcgtggcgatcacgccgctgtatgtgcgctggaaaatctggatgtcaagctcatcctcaattgatttgacgatggcgctgagcgtggtctgcccgatataaagctgtttggccgccaacgatatggatctgcgctttgcaatctctgtgatgtagatcagatgttcaattttcaccgcaatgcttcccctttcacagcaattctttccccgataagccttgatgtatttatggtgcacctcctgtatatgcctgttgcagcacagcgacaagcccatttgaacttgtgtgccgcaaagcgtcggtaaaaccggcaaggccggttttgtctgtggtgcggcatacgcaatccgctgcaaagcagcggccgccgccgaatggcggccgcgaacggcaaagtcattttccttgggcatattgtaacataaacggcgttcgattttacaggataaatccattctggaaatgtgcttaaaaagtcgaaatttatcgaaaatgcagggacagccttggataaaggctgcccctgcaaaataaaaagggtttaaaatgggtttcagacgattgcgtttgccacaaccagggtcgggatggcgacgagcagcgtcagggccatggagaagcacagaactttgtagatctccttggaatccatccattcggtgttggaatggatgatcgctgcgggagcagaagcgccggggagaattagccccatgttgacaacgtagatcagcgcgataccaacgacgacgggattggctccggtcggcgccaaaaaaggcgtgaccattgggatcaacagcgcgccgaaaccgatattgctgccgatgttggtcaacagcgcggacagcaggatgacaatcagcaggacgccgatggggcctttgcctacaaacagggggccaagggcagtactggcaaaggccagcaggccgctttgctcggagatcaccgcgcttgccaccgccatggttgcgccgaccatgaggatgacctcccagcgcatgctaaaggcggcgacatcaaagaattcaatcagcggctggcgctttttgttgagcgggatcaggcacagcgcaatggcgccgatgccgtaaataccggccgtggacagggtgttgttgaaaaactcatagatgaacgaggacgacggcacaatggaggcgagcaggatgacgccgatgacaaccgcgttaacgaccaggacgatcgtttgccgcttgttcatatgcgcgtattcgctcttgagcgactgtgggtcaaagtcacgcagtttggagaaatcggtcttaaagacatatttcatggccagcgtgtaaagcgtgatggtgccgaaggtgatgatcgcgccgaccgccataaagacggcgaaattgatctcaatgcccgcagcttcgccatactgcatgaccaggctgtactgccagcttcggaacggcacgaccgcgccgcccatcataaagctgagaaccagtccgatcaggctcagggtgacgtacttatcccctcgcttatatccggtcatacggtagacgccgtacagaatggtccagccaaggaagatcatcgcgacggagttgatgatgatgcacacaaaggtaaacgccaggaaataagcataggtgaacaccatcggccgcccgcggaaacacttgcgggagatgatccagcgcgcgacaaactccgccacgccgtaatactgcatcgcgcccgtgaccagataggccatgatgctctggaatacgaccgggtgccccatgctggccgcgatcgcttcattgatggtgcagtacccgctcaggccgagtgcgatgattgcggcgatggacggccatgtgacatcgcagaccgtaaaaagataaaccatgcctaaaaagatgccgagcagcttcatgccaaggggggtgagcggctcaatagccggcaggaagccaaagccaaagatcagcgccaggccgatgatcgaattgataaaatagccgggcttaaacggtttgtattcctgctgtgcgggatgcacaaagttggtcatttctgccatacctgttttcctcctcgttcgttctcagtttgcctttctgtcagccgtattcttaacggtatggtgcggcctgccaatttgggcggcgcgccgcgctgtgaatacaggcctgttatctggaacccggcccggcgcgcttattccatgatccgaagggtccgaaccagcgcgccggccgctttttcgccgcttttttcactgaactgccgctctgtcatgcattcaagcgcgccgaaggagcatgcccgcacacatgccggcttcaggccgttttgaagccgcaggtagcatccgtcgcatttgaccatttttccatcggagggccggtagcgcggcgcgccgaacggacaggccatcgcgcagcttttgcagccgatacaattgtgattgtcataaatggtcatccctgtttttggatcttttttgatgcacccgaccggacacgccgcgatacacggcgcatccgcgcagtggttgcaggcggacgagaggtaagcgcagtaaagcccgccgtcttcgtcaagctccaggtcaaaggtcctgcggtagctttcctcgcgcgcctgcacatcgatgtcgttttgatccatgcaggcgaccgcacacgccgagcacgcgcagcatttgtccggatcgaacacaatgaccgatttcattctcccacccccgaaagctttctgatattgcagcgggcgcccttgaagcccggatagccggaatacggatcgagatgcttttccccgatgagcagattgacgttcgcttcggtgtagccgtggaccatgaaaatctgcccgcgtttgatcttgcgggtaagcttggcttttacacggatttcgccgtgacggctgtaaagcgccacatcgtccccctccgcaatgccgagcgcggcggcgtcctcgcggttgatttcgcagcacgggtcggggcgcaggctgcgcgcccaggggacttcgtgcaggcgcgagtgaattgtgttcggcacacgcacgcccgtcgagagcaaaaacggatagtcgcggcgcatatcgtcgctgttttcatcggccagcggatcggagtagaccggcagcggttcaagcccgcagtcctttgtaaagcgcgccagcgtttccgaatagaactcaaatttcccggttggcgtcttgcagcccttggccaggtattgtccgggctgaaccggctttgcggcgggcacgggaaccggcatgtcgtgttttttcaagtcggcgaccgtcaggccgcagccgtcgatgatccagtcgatgcacgcctcataccccttttcaagcatctcgtccccgagcttcatcgagcgcgccagctcgcagaggatatcggtgtccggtttggactcgtacagcggttcgatcaccggctttgtcagcaccgcatagccgccctggtaggctttgaattcgctgcgctccagcgaggagcacgacggcagaacgatatcggcgtatttggcggtctggctcatgaacatgtcggcgtcgacgaaaaagtcgagctgtttaatcgcctcaagcagcttatccgtcgccgggaacatcttgacgttcataccaagcccaaagatcgcctttaccgggtacggcgtgccctcgatgatctgccgcgccaggtccatcgcctggaactcgtcgcacatcagatcccacaccgggaacttgccctcggcgatccgccgctgcccctcgggctttttgcaggtgtaaaattcgtgctcgcgcgtcgtaaagccggccggcttatgcagataggtcggcggatttggaaagttgccgcccggctggtcgaagttaccggtcagggcggacaggcacaggattgcgcggaacgcctggaagccgttgatgaaatggaccattgtcgaggcggactggttgatcgccgccgggccgttcgtcgcgaagatgcgcgtggcctccataataccggccgggtcaagaccgcagatggaagcgactttttcaaggccgaactgcttgacatactgcgcgtactgctcgtagccatgcgtatattttttgatgaagtccatgtcggcccagccgttttcaatgatgatcttagccataccgagcgcgagcgcgccgtcggtgccggggttgatctgcaaatggatgtccgccaggtttttgacggcgggcgtgatgcgcgggtcgacaatgatgaccttgcctccgcgctccttgagggcgcgcacgcccgctatggaaagatggctcgaatagtagccgctgaacgcccatccaaggaaggtgttggcgcggccggtgtcgggaccggcgggcgcgccgcttgtgaccatgccggcgacgacgctcgcctggttgcaggtgctgtcgtcggtgccgtagttgatcgagccgaacgaataggcgaacctgtgaaacagcgggcggtaccatttgcagtagccgctgaaaaacgcgaccgcctgcgggccatactgcgccttgaccgcgttgagtttttcgccgatgattttatatgcttcttcccaactgaccggctcgaatttgccctcgccgcgctctccaacgcggcgcagcggcgtgcggatgcggtcggcacggtaaacgtactgccggttgttgacgcccttcgaacagattttcccgcggttgtacggatggtccggcgtgccctccacctttaaaataacgccatccttcacatagcagtcaagcccgcagtggtggcccggactgcaaatcgcacacagggaatgcttgatttcaatgccggtcctttcgccggggattttcgccttgagcagtctttcaagctctgtcatttcccgccctcctcataaacgcaatgaacgattccgggatgccgcctgcaagcaggcggcagatcgcggcgcggtcccagatgggtccgctgcacagcagggatttgataaagccgtttttaagcgccccgctgctgtccgcgcggccgagcaggttgatgcacttgacgccggatccgtcccgcgcggccttgatatagtatgggccgccgctgttttcataatagtcgtcctgctcgccgcacaggtggacgtcgcccatgcttatgaaatcgacgtccataaaatgactgatgttttgtacaatgttaaaatcgaatgccgcctgcccgccggccatattttcaccggcggcgcgcccttgaagccccgcgttcatccacaggcccacgacgcgctgcgtaccggactgaagctcgaagctttcgcagcagtcgcccgccgcgtaaatacccggcgcgcttgtgcgcatggtatggtcgacaagcacgccgcggttgatctcaatgccgttgtctttcaaaaacgccaaatttgtgcgcgtgccgatgcagaccagcacgatatccgccggaaagctgcgtccgtccttcatcacgccgcacagccggccgtcctgctcctggatttgtgaaagcaacgcgttaaacgcgagcgacacgcccttttgctccaggcgcgcctggatgcgctgcgccgtcgactggaaggcggccagcgggaacatccagccggcgccgtcggccatcgtcgttttgacgccggcggcgcacagcagctccacaagcttgatgcccgtcatcgaagcgcccaccacaagcgccgtgcggactggccgtccggcgagcacccgtttgagccgctcggcgtcggcggccgtgcgcatgggcatgacgccgggcaggtcatgccccgggatcggcggcacgaacgccgaagcgccggtggaaatcaggattttatcgtaagggccggcttcccggccgcccgcgacaagcgtgcgccttttggcgtcgaggcccgccacgggctggcccccatgaaagcggatggaaagctgttccgtgatttgcggcagcgtcccgaacgggaacataccctcataatgaagcgcgccctttgtataataggtggtcagcatcgggttggacggcgcaaatccgacgtcggaaaagacgtcgatcacgccgctttcgtcccgcccccggatggcgcgcgcggcctgatagcccgcgcagccgaatccgatgatcgcgtagctggacacgtgttcacccccttgccggtggcttaataaagaaattcgtgcagcctggaaatgtcgtcgcagtcctcgatgtggagcagggcgtcaagcgcgcgctccatgcgttcgccgtcgagcacgggggaggcctggatacggaaccggccggcgaactgctcgcggctcatcatattggccgggtggccgagctggcagtcgagcgacgcggagtagctgcggccgtccttgagattgatcgtgaccgtcttgcgcgggaacgaaccctgctggaacatcttaaagccaacgcccatcgcgtcgcgatcggaatccccaggcagcacgcgctgcgccagggagatgacgctcgggttctggagcatcgcgggagaataccaatgcgcgccgggatggcggtcgtgaatcagcgcggagataacgtacggcgtgctgaactgcgcgtgcgtgagcgagcggaagccttcgtcgggcggcgtgtccatgcggccctcctttggcgggtcaacaatgatgtcgcggatgtcctcaggcttgatgccgtgctccgtaaccaggtcatacgcaatttccaccggcgtctgcacccacatattcgcgggccagtgcttgagcagcgtcgtcatgatcagccaacgctcgccaagctcctttgtgtaccactcggggcgcggttcgtccgtgatgtgcagctcgtaatccgccgggttgtcaagcgcgttgaggcagcctttgacgcctttttccaccagctcggcgatcatgacgccttcccgggcgcgcaggccgtgctcatagtgataaaaatcggacatgcagaattcatggaaacttgtcggcagcgtgctgcacgcagcgccaagtccgagcgcctgattgacctgctcacttgtaaagcctttgagcttaacggctgggacaatgcagccgaacagctgccagcttgtaagcccccaacccttggtgcgctgccgcgtcagcgagggctggaccaccatcgcgatgcgctggtaaacctcgtatgcggcgacgatcgccgtgagcagctccctgccgccctttttaagcgattcggccatgacccaggcgaccggcacgatgccggccgaggggtgcccggtccaggcggtgtcctcccagtcgagcagatcggcgagcgtgccgttctgcagcgccgcgcagccgggggaaaggcggtcgcccgtgccccatccggtcgccgtaccgccgacgccgccgttggcgtcgcgggcggtttcaatgatcttgtgggcctcaggggaggctttggctgcaagcgccacgcccacggtctgcagcatgaccattttggcccgttccaatacctccggggggatatcctcatagcgaaggttcgctgtaaaatcgctgagtatctttgtatactgcgtcgtgcaggttcggttgttttcgagcatctctgtttcctccggtctatcaatttgtttggcggcgcgatttcacagtgtcagcagctttccaatggacgagaggtcctcgcagtattcgatttcgaacagcgcagttaatatctgtccgatcctctccacggaaaagacggaggaggcgcgcttttggaagtcgttggctgtttcgccggcgcttttttcggggacggcttccaggatgcggtaaaccttgccaacatcctgcgtatattgttccccgtgctcctcatcggtaaaatgcagcggataagctgacgggtcgtcgaacgcgtcctcaaggttttccgtgccgcgcagcgcgcagcaggcgagcgtcacggctgtctggcagcgaaagccgtattcgaatgcgagcgtgtcggcgccatccgattcatagtggctcgccgggatcacgctgcatacggtgcccatgctcaggcccttgttgatttgaagcgtatcaaggcctgtcagacgcagcgccggcacaagcgccgcgaaaagctgccagctcgcgcggccataccctttttcggcgcgctccttcgccgtgggctgcacggccgcggccacgcgttcataaacctcaaacgcgagaatcagcgatgtaagcagctccctgccggatctttttttcgcctccgcaaccgcccaggcggtcggaacggccgcgcaggcgggcataccgaaggggttttgttcccatccgccggcacaggcggccgcgccgttggccatcgccgcgttttccatgctcaggcgcttgtttacaccccagacggcacacgtcccatccgggccgccgcaggcgcactccgccagagcaagcgcctttttggccgcttcgctttcgacggacgcgagcgcctcgccaatcgtctcgatcaggatctgcttggcgcgctcgacaacgtttgccggaaaatcttcaaaccgcgctgaatttatgtattcagataaaacctgggtgcgatttgtcttaatttcatggtgattaaatcccattgccattctccgttccatcaagaaatttgctgcgtaattgatgagagacgctttcttttgtaaaagcctatggtcagtatacttcgccggataaccggccgtccaattcatgaatttgttggcagccaacaaaaaaaacgatgattcacccggttattccctgaacaataaaaatatggaaacaagtaaaactgatttaagattttagttatgcaaatcattgaattttcaaagccggactttgtaaatgtttcttgacggcggcagagttagttgatattttgttgacagtctacagaatttccgattagacaggtctttttatgaattttataataaggaaaacagggcggttggatttgtttagaaaatccaccggatggaaaggattgatcaacctatgatgacatggcgcggatacatcggactcatctgcccgagcatggcggtcacaacggaggacgattttaatcggaacatgcccgaaggcgtcggcgtgtgttccatgcacatctacttcgaaccgatcgggcctaccccggaaaacctgcgcgagatggtaaaggggcttgagggcggctgcaaaatattcgacgagccgcgcgcgcggccggacgtgattatctttggctgtacatccggcagcatgatcaacggctttaccttcgacaaggagtgcatcaagctgatcgaggataaaaccggcgtgcgcggcctgacgacaagcaccgccgtgctcgaagcgtttgagacgctcggcgtcagccgtccggctgtcatcacgccatatcctgaggccaccaacgtaatggaaaaggcgtttttggaggccaacggcctgaccgtcaccaatatcgtcgatatgaacaagcagcgtctgtgggtcccgctgattgaaccgacctatgtctatcagcagatcaaaaagatggacttaaacggcgccgactccatctttatcagctgcacggggctgaacatcctcagcatgatccccattatcgaggaggatttcggcctgcctgtcatcaccagcaaccaggccagtatctgggcttcgctgcgttatgcgcgcatcggtgcgaagaacccgaagctcggcaaattgatgcgcgagttttgagccttgttaaaaaaaggaatgggtccccccgcattgggcgggaggacccattcctttttttatggcgctgttgatcagatgcgcttatagatctctgcaagcgtcatctccggcgggaagccgaggttttccagtgtgcggccatccttgatataatcttcgccgcacagaacgccggcaatctttaaaaatgcttccaatacaggcgcctcaagccccaggcgcctagcgaccgacagcgcaaacgcgccgccgcaggaggcgtcctcccgcagatagcggtgtgtgacgctgtccggcccggacagtgtacggaacacatcgagctgtgggttttctttgacattcacaatggtttcgaacatgtccatcgggttggaatgctccgtaaagcccatcgcttcgatgatagccaggcgttcctcccggatttttcccgcgcagcgtatcgacgcgggcgtaaagccctcctggaacagaataaagttgtcgcgcatcgcctctatgcgcgtggcggaaagcaccgtcgtggccagatgcatcacgacgttgtcggcatggatcgccgcctcgaatacgtttttgaccggcacaaagtcccaaacccccttgagcgcctcaatgacgcgcggcgtatcgcaggcgggcagggacgcgatctttttcgggcgcagcggcaggccgaccgtcacctcagcgtcctgcgtcagccggcagggacagaggttgccctcctgttcggtcagggtgactttttttgtcatatgaagctcgtcaaatacccggcggaatatgaacgctcccagattgccggggacgatcaggatatgctggccgtcctgcaaatacggcgcgattttgcgcgcgatctcctcatggcgcggcgacatcacgtggactgcaatgagctgcgcgcccgcaacagccttttcgatgtcggttgtggcggtttctatccgtccaatcgcatggaccttcccgcgcagcaggataccgccgttggcttcgatctgtttaaaacgtccggcgaaccgttcgccgtcgcagagcgtgacgcgaaagcccttatcagcatagatcgccgcagcggcgtggccggtggccccgccgccgatcactgtgattttttcgatcaattgggcacctcttttcctgatttttaaaggcgctgccggcaggcagcttcgcgaaagcgccgtctcatccatttcattgtacggcctgtgcgtttgacagtcaaatcgttttaattgttggggtcagcaaaaaattcggcggatgcgcgccgccttcctgccggtgctgttcgattttacagaaaatgaagatataatttgtatgatatattctttgtaatataatatatgtatatattttagtacaaagaacatatcggccgcacggatgttgttagtataataattgcagagcggttgtcatactgctgtgcagccggcgcgtccgctccgcagatatggacatatgggaaaaaggatgtgttgttatgaaaacagccggatggacggcttgttacgccggtatgcccattatattggcggactgggatgaggatacttttgaggagccggtacgatgagcggttttcagctttcaactcaaagcgcccagcgcattgtcgctgagatcggcggcatcgtggggcaaaacatcaatatgatggacgcgcagggctacatcattgcaagcaccgatccggcgcgcatcggctttttacacgagggcgcgcgccagattattgaagaacggctgccggaactatatatccgcgcggaggaggcgactgccacagcgcgcaccgggcttaacctgccgattacgcaccgcggcgatattgtcggcgtcatcgggattaccggcgagtacggacaggtgatcggatatgggcaggttgtcaagaagatgaccgagattttaatcagggagagcacggagcaggacgacaaacgccttgacctgcgcatgcgcagccggtttctggagaactgggtgcttgccggcggccctgtgcaggggcaggcgcttgcggaacgcggccttgctctcggcatcgatatcaccatcccacggcgcgtcatggtgatcagtgcgcaggaactggagcattataccgacaatatggccggccagaagctgattgaaaatgtggaaaatgcggttgccgcgattgtcgaagctgaaaacggcaacattatcctgcgaaatgcagcccgtcagattttgctggtgcgtcagcgcaccgatgaacagatgcgcgcgttggccctgcggctgtgcaagatggccaggcagacctttggcgtttatctgtgcgccggtatcgacggcgaggcgggcgacgtgcataaagcttacgcgcaggccaatacggcttggcgcagcgcgcgcatgacgcgcagcggcgtaatgaaatacgaccaggttacgctggagctagtcgccgacgaggtgtcgcgccagacaaaaatggagtttatccgcaaggtgttccgtggctgcggctacgaggaggtgcgccgctggatggggattctggaggcgtattacgagtccgagggttcgatctccgcagcggcgcaggcgttatatatgcacaagaatacccttcagtacaagcttaaaaaactatgcgacattacaggccgcgacgtgcggctgccgagcgattcgccggttttctacatggccatgctgtttttcaaggaagtcgagggcagcctgctgcttttggacgattgacacaaaaagcccgaatcaaatatataacgggttggtatgaaggacaaaaattcaggttgttttatgggaaccggcacatagacaacttgagggcaaagacgatagaataaatttgcagggggataaatgggcgtcattgtggcgcgttaaaagagtcccctgataaaagaaagaggtagaaaaggagagaaaaatcatgaagcaggtcaaaatgatgtcgcttttgtcggctttcgttgttttattgtcggcggcagcttgcggcagcaataccccccccccccccccccccccccccccgaggcatccactgagactggaagcgccccggtagcttccgccccatcagaaccggccgcgcaggctggaggcgctgtacgcggctatacgctgatctctgaaatttgcgaatacaaccctcgcgtaacggcgattgccattgagtatgacaaggagcttcagcttgccgtcgatttggttgaccgctatgaggtgacagcgcagcttgacgctgtttcaaactatgccggcgaggagctgccagacagcatacagccaaaagcgccgcgtgaaattgtcagggcgtatacctcggacggcccaaacgtaggcgtcatgaaaaaagggaattatgtgatcctggagcttgacccatacgacgaaaatgcatcggcagtctatcttggctattcctacataccggaaggtggggaaaagggccagtcgaaggaaatcctgccctacggcgacaagatgatttatgaggtccggcagacgctgcccgtcaaatatgcggacggcagcctgaccagcacaggcgatacattccagcaggcgggctatcagacacagatcgtggatgattttacacaacatctgtatgaatcggaaacaccgggcctgacctataaaaagctcgcatacaatttgtatcagcccgaggcagaggaaggggagacctatccgctgatcgtatttttgcatggctccgcctcccgctccaacaatctggaagggcatgacgaaaccctttccccgctttataacaaccagggcggtatcacatgggtgaaaaacgccccggggccggcatatgtctttgtgccgcagtatttcgattatccggatgtggaaacgaacagcatcaactggagtcatcctgatatcacaacgatgacgatggaagttgtgcagcagtttttggacgacccctccatgaaaattgatccgaaccgcatttatatttccggcctttcgatcggcggccgcggttcctggaccttcctgcgcaatcccgagtactccgactattttgccggtgcgctgattttgtgcggttccggcggtgtgacagcgtgggatgtgattacggacgaggagttggcgcagctcaaagcggtgcggacgagcggcctgccggtgtggctgtaccataacgatacagacccgaccgttccggtggcaggaagccggaacgcatataaggtgatgctggatattccgctggacgccccgatgccggaaccgactgcggaaacggaagattaccgttattatgaatcggccgacggcaagatcaaatacacggaactcaagttcaagccggatcaggttaatgataatcttggtatctacacaccggttggccactgggtatgggaaaatacgtttaagaataaggaagtcattgcatggctgtttgagcagaatttgcagaaccgggcaccgactgcattccctggctaatatgatttgaatcgctgtgcgccggccgtctggaggagacgacagacatggccggcgcgcagccggtgaaaataatgaggaggtttttttatgacaggctttccattgattatcgcattcatcattgcggttatactgatgattgtggcaatctccaaattcaaaatccatccgtttttgtcgatcatgggcgtttcgctcatcctcggccttgtagcgggcatccctctggtggacgtcaaggacgcaaacggagcggtcacgtcgcagggattggcgaacgtcatcggcgcgggcttttccgggacgtttacaagcatcggtatcgtgatcatcctgggcgcgctgatcggcagcatcctggaggcgaccggcgcggcgttcaagctggcggatctggtgattaagctcgtcggcaaaaagcgccccgagctggcgattctgctgatgggctgggtcgtatccatcccggtattctgtgattcgggctttgttatcctcaacccgatccgcaaggcgcttgtcaagcgcaccatgacctcgagcgtcgctatgacggtcgcgctcagcgcgggactatatatttcgcatgtgttcatcccgccgacgcctggcccgatcgcagccgccaatacgctcggcatagggaacaatctgctgcttgtcatgggcatgggcgcactgtgctcaatcgccccgctgattgccggttatttctttgcaaagtacatcggtaaaaaggtcaaagcgggcgacgacattgacaacggcgaggttgtcaagacgtatgagcagctcgtcgccgaatacggcaagctgcccggcgggctgaatgcgctggccccgatcattgttccgattctgctcatggcgctcggttccatctcctccatggccggttggtccgggatgacggcggcggtctgcggctttttgggtaccccgatcatcgcgctggcggtcggcacgatctttggcgtcatccagctttctgtcgcgggcaggatggataaattttatgagatcaccaatgaaaccctcaaaacagtcggcccgatcctgtttgtcacagcagccggaggcgtgctcggcaaggtgatttcctcgtccgatatggtcaattacatcaccgccaacgcggcggcgctcgaaaccatcggcgtattcttcccgtttatccttgctgcgatcctcaaatcggcgcagggttcctccacagtggccatcaccacgacagccggtattcttgccccgctgatgggcgtgcttggcttcacaacaccggtcagcgccgctttggcggttatggcgatcggcgcgggcgcgatgaccgtttcccacgcgaacgattcgtacttctgggttgttacaaactttggcgagatgacgccggatcagggctacaagacgcagacgatgggtacgctgatccttggaatcgcggccatggcggagatctttgtcctgtccctggttttctgagatagaaaaggaaatatcggaaagggatgtgaaaatgggaagttcagcaacaaagggtgttgccgctgccatcgccgctgttgtggtgtgcggattgatcggtttttctgcgcagcacacggtgcgtatgagtgaaggaataaccgcgggaatgccggttctgacgacaagccaaaacagcacgctcacgccgaccgaagggattcacacgcccacgcaggaggagctgaaggctgcctttaccatcagcgcggatacattgagcgcctatgcatgggtcaatgaggcgcagtgtaccatgccgatccgcgaggtggcggtcgatatccagggactcaacgccggccatacatataaaacagagccggagcttcaggataagcagttgggcgcgcagggcgtgctggtggtgcgtccgtacagcgggccttggaactggatgagctacgagacgatcgagacaatcgaccaggtgctcgacgcggtttacgacaaatatgacctgcctgcggatacgccgcttgtcctgtttggacgcagcatgggcggcgtgggcgcgctcaattacgcgcactacggcaagcatcccgtttcggcggtcgcagtcaactgtccggtaacaaacctgtcctatcactgcacggagcggccggactgcgcggcgaccatatacagggcgtataattattacgattgcagcgttgaggaagcggtggcgcagcacgatcctatgcagtttatcgacgagctgcccaaggtgccgtatttctttgtcgcgggcgacgcggatgtgtcggtcaataagggcgtgcattcagatgtctatgttccgctgatgcgtgaaaaaggatacgatgttacttaccttgaggtgcccggtatggcgcatgtcgacctgttgaagcatcccgaagcgctcaaacagtattctgactttatagcaagtttcgcaaaataagaaccggcaggacgctgccgtaaaacggataaggtgtgaaaaatcatgcataaatttattctgatccccgattcctttaagggcacaatgtcgtcctccgaaatctgcgcggttatggaacaggccatccgccggcacgtgccggcggcgcaggtgtacggcgtgcccgttgcggacggcggcgaaggcagtgtggacgcatttttgggcgctgtgggcggcgaaaaggtcgacgcgcgcgttcagggaccgtggggcgaggatgttgatgcgttttacggtgtgctgccgggcggcgtggcggtgatcgagatggcggccgcggcagggctgccgctggtgggcgagcggcgcggcgccgagcagacaaccacctatggcgtgggacagctcatgcggcttgcgctcgaacacggatgcaaaaaaatcatcatgggtctgggcggcagcgcgacgaacgacggcggctgcggcgcggccgcggcgatgggagcagtgttcagggataccggcggcgaagcgttcgtcccagtcggggcaacgctttcgcgcatcgactccatcgacctgtccggtatgccaaaagagcttgccggtgtggagattgtggccatgtgcgacatcgacaatcccttgtgcggggagcttggcgcggcgcatgtgttcggtccgcagaaaggcgccgatccggcgatggtcgagttgctcgacgcaggtcttgcccacatggccgggattgtgaaaaaggaccttggacgcgatatcctttcgctgcacggcgcgggcgcggccggcggaatgggcggcggcatggtcgcctatttcggcgcgcagcttcagatgggtatcgaaacggtgctcgatacggtcggcttcgacgcgcttttggacggcgcggatatggtcttttccggcgaggggaagatcgacttccagtcgctgctcggcaaggtggtgattggcgtcgcacgccgcaccaaaagggcgggcgttccgctgatcgcggtcgtcggcgatatcggcgacaatattgacgccgcgtatgaagcgggcgtatcggcaattttcagcatcaaccgcgtggcggtcccttatcagcaggcgcgcacgcgcgcaaaaaacgatctggcgctcaccatggataatctcatgcgcttttttacccggatggggttgtaagacgtacccaagtcgtaaatcagccagccgccggcccacaggccggcggctggctgattgcttctaggcatgttcaagcaggcggacgagcgcctgcacactgccggccggcgccgcgcacgcaccgttttgacaaagataaaacagcgcgccgtcctccgggatgggataggcggcagtgaagggcgcgagccgctccaaaagggctgcgttcgacggcgttttgataagcgtatgcagccggcggcgctccgcgagtgcaagcagcccgtccgggactgtgccggatgttgcgcagacaagctcgcgggagggatagagcgcctcgcccatggcgagcagcgaaaagcagtgccctgcgggatacggctgcgctttggaggccagaaaagcgagctgcccgtccgcgcgtgtctgccagacgggatcgcccgtcagcttccacagcctttccaggacaaggcacgccgctgcgtttccagagggcatcgcgccgtcgtagacctccttgggacgtgtgatcaggcgctccgcgtcgtcggccgtgaggaaaaaaccgccttcctgtccgtcccaaaaatgcgcttgcagcgtctgcatcatagaaactgcttcttcaagatgaacagcgtcgaaatcagcggcatacagctccaaaagcgcccaggcataaaacgcatagtcgtcaagctgtcccatgttggccgcttcgccatcgcgccagcgcagccacagccgtccgtccggtccggtgaggctggcgtgcaaaaaggccgccgcgcgccttgccgcgtcaagataccgcgcgtcgccaagcgtgcggtacgccttggaaagcgcagcaatcatcagcgcattccaggcggtcagcaccttgtcgtcgcggtgcagcgccgcgcggctgcggcggaagtcaagcagcctttcacgcagcctgccgaagccctccggctcctgttcatacgctgtgttttccaacaggtttgcgatgcttctgccctcaaagttgccggattcggtaatgccgtaccagcggcaaaagcgcgccgcgtcctgcgcgccgagcgcctgttcaaccgattggggcgtgagcaggtagtacgcaccctcctcgccgccgctgtcggcgtcctgtccgcagtaaaacgcgccttcggggcttgtcagctcccgcaggacataatcgagcgtgcggcgcgcggtcgtctcccaaaacggccggccgttctgagaaaacgcgtccagatatgcataggcgagcagggcgttgtcatagagcattttttcaaaatgcggcgcaagccaccgccggtcggtggagtagcgtgagaaaccgcctcccacctggtcgaacaggccgccgcgcgccatctgcgtcagcgtcctttccgccatggaacgcgtgtctgcggatttctcccaccgggcgtagttcatgagaaagagcaggttgtgcggcgaggggaatttcggcgcgtccccaaagccgccgtcggccggatcaaaggcggcgcgcagttggccggccgccgtgtgcagcagcgcgggctgcggcgcctgcgcgccgcctggtccgcgctgcgcgatatacgccgcaatctcgtcacccgcctgcaaaagctgttcgcgctccgtcctccaaagcagcgacacgcgctttagcaggtcgatcaggccgggctgcccgtaacggctgtatttgggcagatacgtacccgcccaaaacggtttttgctccggcgtcatcaaaatggtcagcggccacccgcccgaaccggtcatcgcctggcagaccgccatatagaccgcgtcgatgtcggggcgttcctcgcggtccaccttgattgaaataaagccgctgttcaggacatcggccgcctgtgcgtcctcaaaggattcgcgctccatcacatggcaccagtggcaggtggaatagccgatggaaagaaagaccggcaggtcggcgcggcgggcggcggcaaatgcctgttcgccccatgggcgccaatcgaccggattgtgcgcatgctgaagaagataaggggatttttcatgaatcagcctgttttcatgcatcacagcaaacctccgatttttatgaaccaattgtatcatgttccatcggtttagcgtagcacaaaacagtgaaaatatacccgcggggccgcggttgcctcctggcttgcatcgctgcggagaaagcggtaaaataaggatggcgctgcaagcgcgcaggggaggggaaaaaacacacgatgaatgcggttacatttttggtcaagccggcctccggcctttgcgatctctgctgccgctattgcttttacgatgatgtgtccgacaggcgtcaggtcaaaagcatgggacttatgacgcaggagacggcaagccgcctgattgacgcaggctttgaggctgtgcagcccggagggactatgcaatacctgtttcagggaggcgaaccgacccttgtgggcttggattggctgcgcgcatttgtacagaatgcaaaggaccgttgcccgcccggtgtgcagctgtgctggtccatccagacaaacggtatgtgtttggacgagcaatggtgcgcgttttttcgtgaacatggctttttggtcggtttgtctgtcgatggcacacgcggtttgcatgaccggtttcggctggacccgcacggaaagggtacgtggagacgcgccgtccaggctctggagcaattggacaaaagcggggtggagacaaacctgctgtgcgtggttaccggacctgcggcgcgcagtccccataagctttacagcgcgctgcggtcgctcggcgagcatccgcttcagttgatcccctgccttgatccgatggaaaacagcggcgcaatggattattccctggcgccgcgcgattatggccggtttctttgcagtctgttcgattgctggtatcgcgattgggcggcgggcgtctatgtcagtatccgcgtatttgacgattatctgcgcctcacgctggggatggaaccgggctcctgcgcatccgccggacactgcggcaattatttggtggtggaaggcgatggagggctgtatccatgcgatttctttgtgcttgacgaatggcgtatgggcagtatttgggagaatacggtgcggcaggcattggcgtcgccggccggccgcgcttttcaggcgcagggcgcgcgccggccgccagtctgcaagacgtgtgtccacgagccgctttgccggggcggatgccctcgggactgggatttctccgggcctgagcctgtaaacagatattgcgaggcgtttcgatgctttcttgactatgccgcgccccggctgcggcgtgtggcgcggcaactgtccgccgcaccataatatacagataaaaggataacggaaagggccggacgcagacgcgtccggccctttccagcggattacagatgtttgacagagactccctcatatattttaggcggcatgacaaaggaataccccttgtcgtcacagtcgcggttatcgatcatgcgcatcaggcaatttgcaaccagcgcgcccatctgatagccctgatgaacggagcaggtgactccctcctgttcccagtcctccatggaatagtcaaaacagacgagagagtaatcctctggaacctgtttgcccatctctgagagcgcctgccgcaccagacggtaaataatgtagttgcagcatacaatggccgtacacctgggcaggctctttaaaaacttctcaatggtacggacgaagcgaatgtcgtgcgcttcattcgagacgcaccacttgatataatcatcctggaattcaaccccgtatttgagcagggcggccgccatcccttgaaatttttcgacgctctggtaattgtcatagacaaagataccggcgatctgtgtatggccggcccggatcagcagaccgataagccggtcggcgcattcaagatcattgacaatgatacggggatagcgcagattcttataataattgttgtaaaagaccacggggatgcgccggcgggaaagctccttatagcaatccagattgggattgagaatgctggcctttacgccgtcgataataaacccctggaagttctgatacatgaccgattgcaggcaccggcgctcatttgaaaatttattatccgtcagaaaggtgcgcagcgtcacctggttggcgggcagcacgctctggatgccttggatcaggctggaattggcgctgctgtcctgcccctgaaggatcaggccgatctttttgcaatggaccgcgccggcgtcaagctcataggagagggcgacctccttgttgaagtacgtcccgctgccccgtaccttgtaaatcaacccctcctgcaccatccggtcgagcgccgcgcggaccgtttcacggctgacatccagcctgcggcacagagcgttttccgacgggagcttttggttgctggaaaacctgttttcatcaatataagccaggatccagcgatacacatactccgattttttattggaaacgctcacgccgttcactcctcaatccgtgatgacaggccgcataccctccgcgcgttcgatccagtccagcaggcggctgcgcagatcggccttcacatccgcataggccggatcggacaccacgttgcaaagctgccagggatccgtgcgcatatcgtacagaaagtcgtcggcatatgtatcggagctggccgccgcgccgccgtttaagcccggcgcgtagacggaatacaaaaagtcaggcgtgcggatgcaccggcccacacggctttctgaaatttgggcgaacacctcgtttggtctattatcgtcctttttctccaccacgtcaagcagattttccccgatcatccggtcgcccacctccacgccggccagggccaggatggttttgggcaggctctcggtgctcacaagctccttgatcgttataccgccccggaacggaccgcccgcgataacaagcggcacatgcaggcaggcgtcgtggcaggaacgcttgtaatcatcatagccgttgaggtggctgtccgtgttcctggtcttgaaatgggagccgtgatcagaggcgaaaatgatgacggtattgtcgtacagccctttttccttaagccttgccacaatccgccccaaattttcatcgagactggcgcattgccccaaataatcggggtattcctccgcggcgttgccccccaaaacctccagatcctttggaaggatgaaattcttgtatttttcctttgagccggcaggtccttcataatgctggcggtcgttttggtgatgcggctcgatttgggagatagtcataaaaaacggtttgcctggatcgcgcgtgtcaaaaaattccagcgccatgtctgtgatgcagtcagggcgatagcccttgaaatcgatgcggttgttgttttcatcaaatacatagccgtcgtagccgtgagaggtgaattccaatacgtcggcggcgcgccagaagccggaatagcctccgcgcagctcgcgcgggatcgcggtgacggtgtgatcgatggtcggaggcttttcaagctcaccatcgctggccagatgccattttccgatataggccgtctcataaccagcctgctcgatgtagtccgccagcgttttgacgcccttgggaagcatgatattgttgcggaaacagccggtttccgtcggatatctgccggtctgaaacagagcgcggcagggcccgcatactggctgaggggaaaaggcgttgtcaaatttgacgccctgcccggccagttcatccaagcggggggtgatatccaacggttggccgaagcagccgcatgtatcccaacgctgctgatcggtgaaataaaaaagaatattgtaggccataacgtcaagcctccttttgtgcggccgctttgacggctttttgttccttcagcttgccgcggataatcgcacccactgcaaggacgatgagaagcaggaaaatgatgcagtagacgctgctgaaaaagatcgaggggctgccgtcggagatctgcaaggcccggcggaaattggtttccgtcatcttgccgagcaccatgccgagcaggatgggcacagcgggaagatccagcttgcgcagaacccatgcgatcaccgcaaacaccagcgtaacgccgatgtcaaaatagtttttattcacggaataggcccccgcgaagcagaaaatgacgatgacgggcgtaaggatctcctgcgggatggagacgacctttgcaaagagctgcgtcagcagcttgccctgaatgagcataaagagatttacaagaatcagtccaagcataatggcatacatgatgtcgccgtcggtggtgaacaggctcaggccggggttgaggccgttaatcatcagtgcggacagcataatggccaccgtgccgtcaccggggatgcccagtgtcaacagagggatcagcgtcgcgccggttacggcgttgttggccgattcagcggccgcgatgccttccacagagccgttgccgaattcctcaggatgcttggacatgtttttcgccgtgttatagctgaaccaggaggcttcggaggcgccggtaccggggataatgcccacgatcacgccgatgatggaggaaatcaggatgggacgggccatccgcctgcgctcctccttggtaatcaggccgttgtccttcattttttccgtgtcaaggtgcagcccccgcaccttttccgcctttgcgagaatctcaaccaatgcgaacaggccgattaaacagatggcgagatccaacccgagataaaggcgcgggatgccgaaagtgaaccggtcgtagctggtcatggggtcggctccgatgcaggagatcaaaagtccgagacaggcggagatcagcccgcgaatcatgctttttccggatacgccggcgatgatggtcagaccaaacaggcacaccataaagtattccgccgtgccgagctgcgctgcgatctttgccacctgcggacccaaaaacagcagcatcagcgcggagaacacgccgccgaaggtggaggcgtacagagcaatcttcagcgccgcctttgtacgtccccggttggacaggggatggccgtccagcatggtggccgcggcatgcggcgtgccgggcgtattgatcagaatagccgagacgctgcctccatagccgccggcgcaatagatgccaagcaggaacatcattcccgggatggcggtgagctgataggtcagcggcaaaaacaaaatgacgcacaaaataacgcttaatcccgggatggcggcgaataccgcgccgatgaacacgccaaggttgatccaaatgatattctggagcgtgaacagcagccccgacgcagggatgatatattgcagcataatacgccccccttagaaatttacgttcaggccgaagcggaacgcggcccagattgcgactgccaaaataacggtgactgcatagtaaagcggttttttgcagcgaaaatagagcaaaaagccaatgcagcagaaaacagaacccgccgcgaacaggttcgtaacacggcagacgacataggtcagcacgaggattgccagaatgaccagggctttgatttcaaccagcaggttgacggttttgtatgtaatgggcagctttctggctattttataaagctcttttccgatcagcagcgcacagcagaccatcatgacgatcatcagcagcctggggaacatccgtccgttgatgatatccttttccgagattgtgacctgctgcggcgtgaccaacaggataacaatcgcaaagaggaagaataaaattcctccggccaggtccgtggggatgtgaacctctttttttgccaggttggcgccaatggcatccaggcgggcgtccaggcgatccacccagtttttcatgcggtacagcctccttctgataacagattgggtaaaaaaaggatggggtgggagcaaacccatcccatcctctgtgtttgagcgggatcaaccggcgacaatatccttatattcgttgacaatgcctttgacgttttccacatgggcgttgacgtcctcggtgctcatcgtatcgacctcgagcagcatggtgtcctggagccaggtcttgacctcgtcgtcggccagtatctgatcgtaaagatctttcagattggcaactgtcgcggcgtcggtaccggcgcgcgccataatgaagcagcggttgcggaagtatggataaccgtactgtcccacaccctcaacgccggagaaggggccgttttcaatggccttttcatcgaaggcgcagacgatgctcacaccgccctgctcgtaggtttcgaggatctgcgactgatgggacacggcaaaatttgtctcccccttggcgacagcctgggccgcttcggcggcggaggtgtacggaaccagctttaaatgctcgccggcgcccatggaaccgaacaaagccgcggccaggaacgcttccgagctggtcgcaccgttaacggcaacgctgacctgctcgccgctttcgacgtaagccttcagatcatccatgctgttgatgttcagcttggcgtcggcggacaaaacgaagatggaggagtacaaattttcaacaaatacgaaatcgtcctgtgtaaactggagcttggcggggtccagaatcgaggtgattgaaagcaggccctcgcccacaaagacaagcttcggatcattggcctgtgtgtcagtgatccatgtgttgacggtagccgcgtcgcccgcaacggcttcggctaccagaatgatattgtctgaatatgtcgttgacaaggccgcagccttttggctcaccatggcggccactccggagggcgcccatggacaggtgacggtccaggtggcagttttgccgccgggcgtgtttgcgccgccagccgtgttcccatcgcttgcagctggggcagtaccgccgccgcatccagccagggaaccgacaagcatgatggacgcaagggtcagactcaataaacgctttttcataatcagtctcctctttttacaaattatgaacttgctattgtttgattttgtgtaattcgccacgaagccgcatcaacaatatagcatggcgaaatttggtattcaacaagttatcaatattttttacaaaagttgtatggtgaggagctggttttataaaacttgtatttttgagttttgggtgattggacagtttcgcaaaattcaagagttgatttttagataattttgcaatcattttcatatacgcagccatacggaccgatttcccatgcgttcagaccatcccagccggcagattcagaaaaagacctgccgctccgcacagaatcatgaccaaaatagggttccatttgagcctgcgcagaatgaaaaaggctgtgataaaggtaccaagaccgagccaatttacattgtcaaggcgtgctgatccgccgtcaaaggcgacgagattcaggattgacagcccggcggaagcgatcaaagctaccacagccggacgcaggctggccagaacgctttgcagtgcggaaagctgtttgtagcggtagtagacaaaggccagcagcgagacaatcaggcaggaggggaggatacagcccagtgtggcgataacagcgccgccgacaccagcgatacggatgccgacaaacgtagcggaattgaccgcaatgggaccgggtgtcatttccgcgatggtaatcagatcggtgaattcgctcatggtaagccatccatgacttgtgaccacctggctttggatcagcggcatagcggcgtagccgcctccgatgctgaacgcccccacctgaagaaagctcaaaaaaagctgaagatagatcatttggccgccccctttctgcggatgcgctttgcagtctccaggcagataccggcgaatgcggcggccagaatgatgaaaataacgttgacgctccaaaagaatgtagcggcaaaagcggcggccataatcaacaaatgcacggcagagcgttccttgaggactttaaagcccagctcgcagacaacatcgagaatgacggcggccacaccggcctgcatccccttgagcacaagcgccacatagacgttgctggcaaacgccgcataaaaaaaggatatgacagagagtatcgtcatgggcggcaggatggtgccgataatggcgatgagcatcccggcaaagccggccatgcgccatccgaccaggatggccgcgttgacggcaatggcgccgggagaagactgagccagggcagccagatccagcatttcattttcatcgatccaatgcagctcgtcaacaaattttttcttcataaaggtgatgattacaaagcccccgccaaaggtaaatgtactgatgtacaaggtgctgaaaaatagctttcgcaggacagcccctgttttttctgtgttttgcatagcgattccccaattcttgttgtcgtttcagaggcagtttgaaaaatcggaaataccgtctttttggcaaacagcggcgaatgcggcgttaaaaaacctgggactccaaaggattcctgggtttttgtcttgaactcatccgcagactgtaaacaatccggcaatttctctattttcaaataaacactaagcgggctccgtggcggtgggtcgtagcttggcgtcgaaattaaaaaatgcacataattttatttaattttttgcatctttttatggcgaatgacggcgcctttcgatatgatataataaaaacaagaagcctgtcaatacggatatgcgggatgtgcgataaagatataaaaaataaccgccctgcggttatgatacagctacatatccaggccgcattgcaaacgcggttcagaaggcacagacaataatgaaagacggtaaaaaaacatccttgatccggattggatcaaggatgtttttcatgtgcgacgatttaaaaagaaaagcggcttgaacaatacagccagctgtttttctgcatcttgttcagtcatcctcgtaactgacttccatatccacatgcttttcccgcaggaacgcatagatataggcaaaagccagggaagcgatattgccgataatcatcacggggttcaaatccgatcccaacatgcagatgttcagcaccgacatacccacggtcagcgcagcacaaacccacagcataccgttcgagcaatggtacgaagaacgcttccactgttccgggaacaccttgggcaggcggataatcgcgtaggagaacgcgaagttgaaggcatacgacaggatcagcgcaaaatccgccacgaactcaatgtcaaagccaaacacgataggcaccacacccaatagatagtacatcgttaggatataaatcggcgcgccgtgcttgttcagagtgccgaactttttggggaaccaaccgtccacggacgcttgcagcaagctcttggtaatccagctaaacgtggcgttcagggttgtggccagcgagaacaggcatccgcctacaatgaagaagataaagagcggttcaggcaggattttttttgctaccagtgccagagactggtcagccacctgctcaattgggagcacgcctgcggccacaatagaaattacagcgtaaatgccggccactaccaatgtggatgcaatcaacacaaaggggatatccttggttgggtgcttgcactcgccgctataggagatgacaacgaagctgccggacgtggcgtatgtgaggaatgcagccgcgctgataatgcccacaggcccattgagcagatagttggacacaccgccgaacgcgccgggttgaacctgcggcataccgaacacaacaaacgaaccgagtgccaggcccattaccaccagcatgatggtttcaatcaaagccgcctgcttcacgccgaacagattaatgacgaagaaaagcgtcagcaccactagcgctgtggccttgatggggataccgggaatcagggactggagatagtcggcaaagcttaggggcaggattgcaatgccgatgttccagataaagtcacaaatcacataggcgcccgctgtgcgcttgcccaccagtgccgccattttagtatagtcaccaccacgcagacggaccgtcccgccaatgaggatcgaccccagagaatcgatcacaacaaataccgtagacagcaggaacgcataaaacacgctgcgcccagtcataccaatggcggttcccatcagcgccatgatgcccgcaccgatgatctgaccaatcgccagactcatcagctctttcctaccaagaacacgcttcaggtctttggttgtcggcgcagtgctgacagcggccgaatttgcctgttcactcatagttgacctctcctttgaacttcattttgtatagctgctaaatatcagtttaatcatctgctccgcttgcgtcaatactttcccagtgaaaaaatgaaattctgctttttccccaaaattaagtttttttatttatgcatatagtatagcagctaaataatgagggcggggttttttagttttcccttccgaaattctatcccacccaactgtttcataccatcaaacattacgttcataccacattttcatcgtgctttgtggatcaatagccccggcttcactttaaaatcagccgacaggctcgctccccctttttcttctcttaatcattttatcatttaatatctaaattcattatgattttcttttaagcctgcgcatcctggcggacgtgcgtctttcccagccagtaggacttccccctctgccaacttatcagaatattttactgctaaatcaacaaccgacaaaaaaacccggggagaggcacattatctgtgcctctccccgggtttcccatacacggcagcgctgccgtgcggcgatgattacccatcctcttccatcagctcaatataggtagccagcacccggtaaaacacatcaatttcctccgtggtgtggtgtttcaacaggttctgcaaagttttcatcagctccgccatgtcataggctttgtgggccttgctcagctttatcccttcctcgctggggtacaagtgcaccgttttggtatcgccgccctctttgcggcgcagcacatacccggctttttccaaccttgtcaccgtctggcagatcgcccccttggttcggttccaaatttcggccagctccgtcaccgtagtgcctgggttttcttcaatcgccgtaagcaggtgcacctcgcgcatggtcacacagcggcctgtcccatagtccttcgcctcaccgatgtaatcgttgtacatcaccacaaacttatacaggctgtccgcctttgcgctcaatttttcaaatgtagattgcaagctttctgaaccaagccctcttgccatcatgtttccttctttccatcccagccttttttatatagtataggccataaactggaaggaagtcaagcatcttctattaatttgagcacgtgccgcagcagatgtgctcgattctgccgcctctgctcctcctcggtgcgcagcgtcagtgcaccggtggggcacaccctcacacacgcgggcagatatccccgccgaacccggtctgcacagccgtcgcatttgacaatcttcccctgagggtcgaatttgggcgcgccaaaaggacaggccatggcacaactgtggcagccgatacaatgggtcgggtttacaaccgtcatcccggtttctggatctttgtgcaggcatcccaccgggcaccctgtcacgcagggagcgtcattgcaatgcatacaggccatggacaggcccaggaaagcaacccgttccccctgctgccgctccagccgggtgacccagcgcaacgccgggtcgccgtgctccaggtttgtgtcatgctgatccatgcaagccactgcgcacgcgccgcagctgatgcacttgtccatatccaggtccagtaaatatttcattggaccgccgcctttctgatgccgcagcgtatctggcggtatcccggaaagcccgtgtaccgatccagatactggcggccaataagctcgtttacatctgcctctgcatagccgtggtacaggtccacatctccccgcagctgccccgccgtgagatgagtccgcacacgcacttggccgtgaggcgtgaacaattccacccagtctccttcctgcacacccagaagctgggcgtcttggggatggatgtccaccatagggtcaggccgcaggctccgggcccaagccaccccatggaaccgggagtggaccgcgtgggccaaacgcgcgccggtggccaatgtaaagggatatcgtgggtccttttcttcgccgaaaccgtcctcatacacgggcaggggcttcaaatccggcctatccattccggcgatcagttccgagtaaagctcgattttccccgtctttgtttcaaacccatgttccagataatacccgggcgtatacgggcgctgattgggcacttccagcggcgccggggcctgccgcagttcttccagcgtcagcccggtaccatggatcaggtagcgcagcgtcgcgtcgtagccagcattgagcaggctgtcgtccacatccagatacctggccagttcgcagaggatctgcgcatcatgcttggattggtacagcggctcaataaccggggtggtgcaagtgagaaaaccgccctcatatcctttgagttcgctgcgttccaaggaggtgcagcagggcagcacaatgtccgcgtggcggcacaattccgtctcaaacaggtcgaccgccacaatgaagtccagcttgtcataggcttctaactgctgatggggctgcgggaacatccgatggttcacaccgatggccaccatcgccttcaccgggtagggcgtgccttcggtgatctggcgcgccagatccatggactggaactcatccgccagcgcgtcccacacggggaatctgcccgcgccgattcgccctttacacgcggcggggcgctggctttgtacaaattccccggccttcatgtcgaacccgcagtctgtgtagagataggtttcgtggaccggaaggtcgccgccttcccggtccaggttgccggtgatcgcctgcagcgcaatcaccgcccgcacattgttgtatccgtttcgatgatgggacagcgcgctggcaggctgatatgtactcaccgggccgctggtcacatacatttccgccgcctggcggatcagttcctgaggcacgccggtgatgcgctgggtctcctccagtgtgaagcgctccgcataggctgcaaattgctcaaacccgtggatataggctttgatgtacgcatcgtccgcccagccctgacagatgatataattggcaagccccaaggccagagccccgtctgtacctgggcggagctgcaagtgcaggtctgccagttggttaaccgtgtccgtcacgcggggatctatgatgatgattttcccgcctgcgtcatggaactggcgcagggcctccccgaatggataggcgttgtggaaggcattacacccccaccccacgaacaggccgctgttctccaggtcacagccgtactcccggccggtcaccgtttgccaagccatcaccatcgaacggtagcacgcgctgctctcggtggcgtaattcaggctgccgaacgagtgtaccagccggtgcatccagggacggtgccacttggtaaaacccgtcacccaggccaccgcctccggcccatccaaccgtttgatggcatttagccgttctccgatggttctgtatgcctcctcccaggtgatgggctggaatttcccttcgccccgcgcaccgatgcgcttcatcggggttttcagccggtcctcccggtacacatacccccgcgtgctggcacccttcacacacagcttgccaaaattgaccgggtaatcctccgaaccctcaaccttaaccagtttaccgtccttcacgtatgcgtcaatcccgcagtggattccagtgcagatggcgcacaagctcttgcgtacctcgattccggtctgttcgcaggggattttcgcatgtaaaagccgttcctgttccgtcatggcttcactctcctcccagttggcgcacaaaggccgccggaacgccgctgcgctccagcagcgcagcctccaccggcccaaatgcgttcgcctctccgctcagctctttgtacatatggtttttcagcacgcccgcagccgtcaggttccccagaatattggcgcattggattttcccatcggcacccaagacagcctggatataattcccacgccccatatctccccaggaaacagaccttcccccgcgccgggtgtcacccaagccaatgaaatccaggcccatgaaatgggtgatattgtgcaggatattgccctcatagcgggcgtctccacccgccatgttcacaccggctgtttcgccctgctttttcgcattggcccacaggccaatgatcatggtctgcccgctttgcagctctgtgccttcgcagcagtccccggcagcgtaaatgccgggcacgctggtagccatgtgatcatccaccacaatgccccggttgatgaccacctcgttctccgccagcttcgtgttggcgcgcgtaccgatgcacagacagatcaagtcggccttcaccagcgtcccgtccgccagctccaggccctgcggcagcacctggcgcgccgccgcgttccacaggaatcgcaccccctgggccgcaacctgcccctccagaaaacgcgccacattttcaaatgcggccagcgggaacaggaacggcgctgcgtcggccacggtagtttcaatgccgcgcctccacagcagttccgccaccttaattcccaccattgaagctcctaccaccaccgccctttccactgagcggctgttcaggtaatcatgcagcccccgcgcgtcagccattgtgcgcatcaccataacgcgtctgtccggcaggcctggcagaggcgggcagaacgcctgcgcgccagtagccagcagcagcttgtcaaattccattttcccgtctttgagcaccaccgcttttctggctgtatcgaccctgtgcaccctcacgccgctgtgaactgtcagccccagttcccggccaatctgctccagattactgccgaaggggtgggccgcgtcgtccgtgatgcggccagaggccagataggtggtgagcatcgggttcgcaggcgcctcgcgagtcgcctcaaacacatggatctcgccctctttctcacgcgttcggattgctttggccgcggaatagcccgcgcagccgaaaccgatgatagcataccgcttcattctggttcctcccctttatctcccatgattttcgagcgccgcggtcagccttgccatggcggcctccaccacgctcttagggcaggccaaattcattcgctcaaagccgctcccatcttcgccgaacacatagccctcgtccagaaacagacgcgcgtccttctgcatcagggcctccagcgcctcattatccatgcccagtgcccggaaatccatccacagcaggtaggtggcctctatcggtgtcaccttgacctgcggatggtgcttggccagatatcccgccacgtaatcacggttctccctgatcacgcccagcagctcttccagccactggtcacatttggtataggcaatctcacacgccttataagacaagatatttagatagtaaatcgccgctgcgtcaaaatgcgccacaaacttttcccgaagctgctcattggcgataatcatgttggaagcctgcatccccgctaggttgaaggtcttgctgggggctgtacacacgatggagtgctgtgcaaattcctcactgatcgaaccaaacataatatgcttgtaaccgggcatcaccaagtcaaagtggatttcgtcactgacaaccagcacgttattgtcaatacagatgcgtccgatccgttccagttcctcccgcgtccacacacggcccaccgggttgtgggggctgcacagcagcaacagcttcacagaggactctttcgcctttgcctcaaagtcgtcaaaatcaatttcataccgcccaccattattgatcaacgaggtttttaccacacgacggtcgttgatggtcatggcttcgtagaatgggtaatataccggcgtcataatcagcacgccgtcccccggctgtgtgaaaacctgtaccgaggcatacagcgcgggtaccacaccgggtgtggtaacaatccactccgggtcaatcttccagccgtggcgacgttccatccagccacagacggcgctcaaatactgctcagtaggctctgtatagcccagcactgcgccatccagataatgctttagcccctctataatttcgggcggatttttaaattccatgtccgctaccgaaagcgggacaatatcgtcgcccacagtcggatctattcttctcatttcttcccatttaaatgcgcccacattccgtcggtccacgattgtctgaaaatcatatttcataaatcaagcccccttaatattgtttagttgctatatcatagtatgataatatctctaccaaaagtcaaggtgttttctctaattccacacatctgacaattttgaattttagattttgtaaaaaaagccggaatcatccctccctatataatctcaattttatctcaatttttcttgctaaaactcctattttctaggttttcaatttcaatttttacaggcagattaccatatcaaccgtttcctccagatttggacagcagtcgggatcaaactcgatcccaattccgctgaagtcacagccgtaaaagtaggaaataacctccgggcatttgtccagcgcgtcaaaaaacagtttccgcccttccaccgcgctcaggtcgctttcagtcaactcctgaaatgcggcgcggtccagataccagccgcggtttttgggttcgaacatccctttctgtacgatgttttccaccgcgtgatccacaatcttctgaggtcaccttgtcccgccatccattctccagcgggctgacgccccctcagaaggaatgacgttcgagccgtttgccatctcgccaatcaggtcatgggtaccgttgcctccctccagcggcatatccgcgcccacatcgaagttctggtacaccgcttgcagtagatctcggtgatgttcgccatatcgtccggggttatagctctcccgacgtaagcgcccacattccgatagatcgtgggcagaccgtcgatgaggaaggtccgcagatggacatatctgctcataggctttacccatgtgggccgggaggtcatcttgatccacagcatgagccgtacccggacagagagctgcatttcgcacactttggagagtatcgcactgcatctgatgctgaaagatgcgaacgagggggagcgataccgcaacacagatcattttgacaaataattaggcggatcaaggaaacgatgtgacggtgatccttaatgacgctgtgggtatacacatctgatgcggcaaggacatcacgattacatcaaaagagacggtatccatccaaagcaaggagagcgatttgggcatttcggcgcagaaccaggtggaaatttctgatggaaatggtggcgttgatgtttgtcgattcggagatctaggcagccattttcaatggtgccctttttcggaataagaaaaggtgccaatccttcagcctgttggctgagaaattgacgcctttggcactctgatttttgctggatatgaaaatagcgccctttttgaaaaattccgtttcaaaaagggcgctgtagatttctaaagaatttgggggttcgaatccagccagcttctgtgaaacccccgtttggatcttttgttttacctgtgaaattcgaggcgaaaaaaacctgaaaagcccgataccatcggcagaaatgccgatggtatccaaagtgagcatactttttggttacgggggcaggatttgaacctacagcttcaaagacacagaaatcatggcgatatcgttccaaattatccgcaatccgctggcaatatagaacgattttctccaaatcaaacgatcacgcatttcgatagagcatcacctcatcttttgcgattaagtccagaaaaacccggtcagaggattcacttgtcaccaaatcaaccggcagcttcaaggcatcctcgacagccggcccaaacccggataactcaaacaaggagcgaagctgtcctttttcgattttcaagtccacatcactgtcggcgccagcggagccttttgagtaagagccgaacaaggacacgctctccaccccatactggagagcaatgggagagataatttgccgcagatcttcaatgctgtaaggaaccataaaaccacctctttgctgtctatggtataccacgaaagacaaaaaacatccttttacagtttgaagataggcaactacaaattgacatggatcagataagcggatgccacgccggtctgcaaatcaaaacttgctccgctttaaacaaagaaaagtcgaaaccgttattctgttgctggcagtcccgcgggaatccttgcgggttttggaggaatgtggtagagtaaaagggaaaagaacataaatcggccggaggacgtaccctatgccaacacttgaatggattggaaaagacaaggtggtaaaccaccaccaggaagtaccttaccgggtgctggagcgccagtacagctatgacgaagccggacagcacgtcaaggacaacggcagtgaaaacatggtgatccacggggacaatctggaggcgctgaaagccctgctgccccggtacgagggcaaggtaaagtgcatctacattgatcctccttacaacactggcaacgagggctgggtatataacgacaatgtcaatgaccccaagatcaaaaagtggctgggcgaagtggtgggcaaagagggcgaggatctttcccggcacgacaagtggctgtgtatgatgtatccccgtttgaagctgttgcagcggctgttggcggtagatggagctatttttatcagcattgatgataacgaacaagctaatctgaaacttatttgtgatgagatttttggagcaaacaattttataactgaccttatttggcgatcagcggattcgtccaacaatgactctaagcaattttcaaacgattacaaccataccttggtttattccaaagcacctgggtgctggctacctttgagatttgcgcgacaagaaaagaataaccagcactacaaaaatcctgacaatgatccccggggtccttggtttccaagtaatctgcaatcccccaattatcgggcaaatcttatgtttgatattatttcacctaatggcaccgccatacatgcccctaaaaatggttggcggtggagttgcgaaaaaatgcaagggtggattgaggacggaacaattattttctcagatgatcaaactagaattattaaaaaaacttttctaaaggatcaagcgggaattgttccgtccaatatttggtgggacgtagacgaaacaggccataatcgtaatgcgaaatatgaactgctcaaaatatttcatggactacatagttccgaagtgttcaaaacaccgaaaccgacaaaatttattgagaaaatacttcaaatgtatgccggtgggtctttgattgtattggactccttcgccggttccggtaccaccgcccatgcggtgctcaacatgaacaaggccgacggcggcaaccgcaaattcatcctggtagagatgatggactacgccgacagcattaccgccgagcgtgttaagcgggtcattgatgggtacggcgaggacaagaaggctgtggaaggcaccggcggcaatttcagctattatgagctggggcctgtgcttatgttaccggacggtaacctcaacgaagaagtgggcgtgcagaaaatccgggaatatgtctactatatggagaccaaagagcccctgcccgccaaacagcccgcggacgagtcctatttcatgggactgtgccgcaacaccgcctattacttctactatgagcgggaaagcgtcaccacgctggactatgcctttttgtctgccatccagacaaaagccgaaggctacaccatctatgccgacctgtgcgccatcccacaggagacgctgcgcctccacaacatcacctttaagaaaatcccccgggacattgcccggctgtaagggagcgcgaagaaatggaactgaaatcctatcaaaaagaagtcattgccgatcttgcacgctacctggatctggtggtggagctgcaaagcccggcaaaggcgtatcagaccctctggaacgaaaagaatgttctggtgggtttcgacggtatgccgaactatgtgaatgttctccccggcgtgccccatgtgtgcgccaaggtgcccaccggcggcggcaagacctatatcgctgccagttctctgcggacgatttttgacgccatgccccagcgccgggctaaggctgtggtgtggctggtgccctcggaagccattttgacccagacccgcaaggcgctggaaaatccagaccatccctaccggcagcggctggatgtggactttggcgggcgggtgcaggtgtactccaaggagcaggccctcatggggcaaaacttcaccccctccgccgttaccgaacagctttccttgtttgtactcagctatgattccttccgcacaagtaaaaaggaaggccgcaaagcctatcaggagaatggttatctggccgagtttgccaagtggatggatgatccgtcggttctgctggccgataccgatgagacggcgctgatccaggtgatccgctatctgaatccggtggtcattgtggatgagagccaccacgccacctcagatttgagcgtggaaatgctgcaaaacttcaatcccagttttgtgtttgatcttactgccacaccgaaaaagaacagcaacatcatttcctttgtggacgccgcacggctgaaaaaggccagtatggtcaagctgccggtcatcgtctataaccgcaggtctcaggcggatgtgtatggggacgccatcgccatccgcgccaagctggaggcacaggctaagcgggagcaggaaaccagcgggcgctatattcggcccatcgttttgtttcaagcgcagccccgcaacaacgcggacagcaccacatacgaaaaaatcaagaaaacgctggtggacggcggaatcccagaaaaggaaatcgccatcaaaaccggcgataaggacgagctgaaaaatgtggacttgctgtccccagactgccccatccggtacatcgtcaccgtcaacgccctgaaagaaggctgggactgcccctttgcctatgtgctggccacggtggcaaaccgcacttctactgtggatgtggagcagattctggggcgtgtacttcggttgccctacacacagaagaatgacagcgaggttctaaatctttcctatgtcatcacatcttccgcagacttccaccagacgctggagaaggtcgtagctgggctgaacagcgccggcttcagccgccgcgactaccgggcgcaggatgtagatgttcccgttatggcacctcccgttccggacccggagcagcttcctattgccccgcctcccgccgatgaaccggatctgccggaggtggacggcatagatttgaaggcgcgttttgaagcggcagcgcatgaggcggagcaatccgtgcaggatggatctgtgcagtccgaccctatgctgtcacaggccctgcaacagaacaaaacctatgaggacgagaacaaccaggccgacaataccgccttgagtcaggctccatcggaggtgcgcgacaaaatgaatcagttccgaatgaatgaggaatttgcaggcgaagccgccgccctgcgtttcccccaatttatgctggagactggtcccagcctgttttcagaagcctacgagaccttggaactggagcatttggagggtggattttctctgcgctctaaagacgcccatgtggatttcaccacggtcaacgctgagatggcacgggtggatgtagatgacagcagggacagcaccgcaaaggcgtggcggctgtctggcggcgacagttccttttttcgggaatggttcaacacccagccctcgggaaaacggctttcgctgtgcaaaggcattatcaagcaaaagctgtccaagatgaactgcgtcaacgaccgggaactggatgagtatatcgaccgggtcatcggcacgatgagcgaagatcagctctctgagctggagcagtcgccgtatccctatgttgtgaagattcaggggaaagtgaaggaattgattgcccagcaccgttccagtgtctttgatacctggctggaacaggacaagatttcctgcctgcccaactatgcgctgcctgtggtgatttctcccacagcctttacctcgatggtgccaaaatcgctttataccgccgaagaagatatgaacgagtacgagttcaaggtggcgtgggcgctgtcggagctggaaaatgtcaagtggtggcaccgcaatatttcccgcttggggtttcagatcaacggccctgtccatgcttatccggacatcattgtgatgcttcacagcggaaaggttctgatggtggagaccaagggcgaccacctggataacgatgaatccaaggaaaagtccaaaatcggtgaccagtgggctagattggcaggaaaacaatacaagtattacatggtgtttgagagcaagcagccggactatccgggggcctattctctggagcggtttatggaaatcgtgaaagggatgtgatttttgcttaacagactctaaaaccaaagaaacttctgcaaatatgaattccgttgagagggattccctgaaaagggaggccctctcaacttatctattcgcaggagactggaacaggagttaccagaaccatttgcgagcacaccaatgttactgagcaaaatagtcatcatttattttgcactttacaaattgcggcagaatatgataaaatcgccttaagaacaaatgttttgtcagctaatgtatttggttagcgaaaccttcataacataccgattttctcagatctacataccaaaacccaacaacgcattccggcacgaagataggcgcttttgtttgtgttgtccgggtaagggtaggcaggtctttttattttgtttttgaaaaggaggttatcgaagtgaaagaatccgtttgcaaaacctatgacgaccttccgctctttctgaatgcggaccaagtggcaaaggcactgggagtcgcatcctccagcgcctacgactcatgcatgaaaagggattcccgacacccaaaatcgggaacaggatgattacgcccaaggaacgatttatccaatggatggaggtttggtttgagcatgacgcgcgggtgaaggtacggccgtcctcccatgccacctaccgggttatatcgacaaccacatcaagcccgccattgggaggatccctctggggaagcttaccacactggacttgcaaggcttctacaagaagctgctggatgtgggcaaggtggaacgggtagaaagcaagcgtcagagtaaggggtttagcccaaagacagtccggaatctctatcaggtgatttccagcgccctccgcctggcggtacagcaaaaaactgatttccccgaactccacagacggttgcgccctgcccaaagccgaacatcaggagatgcgcaccctgacggcagaccaactgggggctttcttccgagaggtgaaggccggcggggtgtttgcaccgctctactacctggaactggctaccggcctgcgccggggagaactgctgggccttcactgggaggatgtggactaggcgcggaaggcgatcggcgtcctaaaagaccaacaaggaaaagttggcgtgggcagcgtctatgtgttcctatccaccaagggggccccgtctccccggacagtgttccgcacatactccgccgggtgctgaacgggcgggtctgccgaaagtccggttccaggacctgcgtcatatcttcgccgccctagccctgcaaaacggggtagacgtgaaaacagtcgccgggataccgggccgtttctctgcgggattcaccctggacacctatgcccatgtgaccactgacgcccagcggccggcggccaatgtaatggggaatttactctctagcagcttctaaacctttccgagcgtttccccgtatgggtcaaagttagggtcaggaaggattccaaaccgacaggggattctgaaaaacagagaaaacccgctgaaatcagacgatttcagcgggtcattggttgcgggggcaggatttgaacctacgaccttcgggttatgagcccgacgagctaccggactgctccaccccgcgatctttttggcactgtttttgagtgctttactattatagcacgtgtatttgagaaatgcaacccttttttaataaaaagatggatgatggacatcattttttgcgccggctacagagctgagaaaataaactgtaaagaatgggtcaaaaagaccgccgtcagcagctatacgggcggattacatgcgattttacacagactttacagtggcacgcttgcagctttacaaatgtgggctatactttggctcgtaccagacaggaacgatcagccgcaaaatacatatgcggcagcataagaaaggtgaaaaaaatgaagaaatatctttgcgcttccatagcaacaattatgattgcagcagccctggccggctgtggttcttccggcgacaatgccgccgcagcgccttccaccactgcgcctgcggcttctacgcccgtggcgccggcagcttcgtcgacaccagcggccgcttcggattttgatgccgccatgccgatcacagtcgtttcccgcgaaccgggttccggtacacgcggcgcgtttgtggagctgtttgggatcgaggagaaggacgctgacggcaacaaggtcgatcacacaaccgaggaggcaattatcgccaataagacagatgttatgatgacgaatgtcgcgggcgatccgtacgcgatcggatatatttcgctcggttccctcaacgatacggtcaaggcgctcaaaattgacggcgccgaggcgactgccgaaaacgtcaaagcgggtacatataaggtttcgcggccgttcaatgttgcgacaaagggcgatgcctccgaggccgcgcaggattttatgagtttcatcatgagcgccgagggccagcaggttattgaggataacggttatatcaaggtcgacgatgcggccgccgcttttgcgggaacaaagccagagggcaaaattgttgtggctggttcctcctctgtctctccggtgatggagaagctcaaggaggcgtatacggcgatcaatccgaatgctaccattgaaattcagacgagcgattccaccgccggcatgaccgcggcgatggacggcacctgcgatatcggcatggcttcgcgtgcattgagcgaggatgaagccgccgcactcaatgcgaccgtgattgccagcgatggcatcgccgtggtcgtagcgccgggcaatccgcttgacgagctgaccagcggccaggtcaagagcgtctttacaggcgaaacgctcgcctgggacgcgctgctccagtaagaaacgaccgacctctccaattcggagcttttcatttctttcttttctccaaagctgtgcggggtggatgtaacaatccgccccttacggctgtcaggaggaaaacccgcccttgactgggagacgaggtgtgttatggcgcagacaacaaatcaaaagaaatataatttgaaggaacgcctgatggagcttttgttcctgatctgtgcgctcgcgtccatcttcgcggtgctgctgatctgcgtgttcctgtttgcaaacggcctgcccgcgatggcaaaaataggactgtttgactttttgggcggacgcaaatgggcgcccaccgatgtgccgccgtcgttcggcattttcccgatgattgtgggcagcgtctatatcacaggcggcgccatcctgctcggcgtgccgatcggcattttaacggcggtgtttctggcgcgcttctgcccacgtccggcctaccgggtgctcaagcccgccatcgagctgctggcagggattccgtcgatcgtatacggctttttcggacttgttgtgctggtgccgttcatacgcaaattcgcgcgtttgttcggtgtgatcagcaacggcaacaccatcctgacagcttcgattctgcttggcatcatgatcctgccgacgattgtcggcgtgagtgaatcagccatccgcgcggtgccggacagctattacgagggcgcgcttgcgctcggcgcaacgcatgagcgcgcggtgtttttcgccgtgctcccggcggcgaagtcaggcattttggcgggcgtagtgctcggtattggccgtgcgatcggcgaaacgatggccgtcgttatgatcgcgggcaatcaggcgcgcatcccggacagcatcttcaagggtgtgcgcacgctgacggccaatatcgtcatggagatgggctactccacggggctgcaccgcgaggcgctgatcgccacgggcgttgtgctgtttgtatttattcttctgatcaatgtttcgttttcgctgctcaaaaggaggatggattgatggagacggcaaaatccacccttaaaaaaatccgggcgatcaaccgaatgagcgccggacagcgcataaaatcatatctgcgccacccgctttcgctcacgctcgcgctgctggtctgcctggcggcgctgatcacggtctgcatgcttgtgttcatcgttgtgtacattctggccaagggtattccgtacctgacgccgtcgctgtttgagcttgaatacacgacggaaaacgtctcgctgtttcctgcgattgtcaccacaattgaaatgacgctgctgtcgcttctgatcgcggcgccgctcggcatcctgacagccgtctatctggtcgaatacgccaagcgcggaaacaagctcgtcggcctggtgcgcctgacgtcggagacgctctccggcatcccatcgatcgtgtacggcctgttcggcatgctgttttttgtgacggctgtgcactggggctattcgctgatttcaggcgcttttacactggccattatgattctgccgctcatcatgcgcaccaccgaggaggcgctcaaatccgtccccgacccataccgcgaagcaagcttcggacttggagcgggcaagctgcgcacggtgttcgtcatcgtgctgccaagcgccgttccgggcattctggcgggcgtgattctggctgtcggacgcattgtcggcgagacggccgcgctgatctatacagccggtacggtcgcgcagattccgatgggaaaggattttctgtttatgtccgggcgcacgctggctatccatatgtatgcgctttcaagcgaggcgctgtatacgaatcaggcatacgccacggcggttgtgctgctgatcacagtgctgctgatcaacacgctgtcggcattgatcgccagacgtctgacgaaaggataaaggggaaacgggatggacacaaaattttcgattgaaaacctcgatctgtattacggggatttcaaagccctgaaaaatatcaatctggctctgaaggaacgcacgatcacagcgtttatcgggccgtccggctgcggcaagagcacgctgctcaaaagccttaaccgaatgaacgatctggtcgaggggtgccggatcaccggaaaaatcacgctcgacggagaggatatctacggcggcatggatgtaaaccttctgcgccgccgcgtcggcatggtgttccagaagccgaacccatttccaatgaatatttacgacaacatcgcttacggcccgcgcacgcacggcatccgctccaaggcgaggctcgacgagctggtcgagcaatcgctgcgggccgcggcgatctgggatgaactgaaggaccggttaaaaaagagcgcgctcggactttcgggcggacagcagcagaggctttgcattgcccgggcgttggcggtcgagcctgaggtgctgcttatggacgagccgacaagcgcgctcgatccaatttccacttctaaaatcgaggaccttgtgctagaattgaaaaaggattacaccattatcattgtgacgcacaacatgcagcaggccacgcgcgtctccgacgagacggcttttttcctgctcggcgaggttgtagagttcgataaaacagacaatctgttctcgatgccgcgcgacaaacgcacggaggactatattacgggccgctttggctaggggctgtttgaaaaaccggcaattcctctattttcaaacaagcccaaagggggaaaggcatatgagaaatcgatttgaccaggagcttgaacagcttaacaatgaactgatagagatgggcgcgctgatcgaaagagccatcggcgacgcctcgcgcgcgttgcttgaaaaggatttggagcttgccaaaaaggcgattgaacacggcgggcttgtcgacgacaaggaaaaacagatcgagcgccgctgcctgcggctcctgctacagcagcagcctgttgcgacggatctgcgcatggtttccacggcgctgaaaatgatcaccgatatggagcgcatcggggatcaggcggaggatatctcggagattaccatccgcctgatcgacgagcagtacatcgattctctccagcatatcccggcgatggcgcatgcgaccacccggatggtaacgggagccatcgacgcctttgtcgcgcgcgacctcgaccgcgcgcgggcagtgattgcgtgcgacgatattgttgacgatctgtttgttcaggtcaaggacgatctgatccgcttaatccgcgccgattccgccaacggcgaacaggccatcgacctgattatggtggccaaatattttgaacgcatcggcgaccatgcgacaaatatagccgaatgggtcgtcttttcaatcacgggcgagcacggcaacgaacgcatcatttaatacccgctcgccaaagggaaacggagggatgccatttggcaaaggcggcggcaatctatctgattgaggatgacgagagcatccgtgagctggttctctatgcgcttgaaagcgcgggctacgcggtgcgcggctttgccgacggcggtcagttctggcaggcgcttgcggagggtgaaacgccgggacttattcttttggacatcatgcttccgggcgaggatgggcttacaattctgcggcggctcaaggcttcggcgcgtttgtccgacacaccggtcatcatgctgacggctaaggcggcggaatacgataaggtacgcgggcttgatctgggcgcggatgattatgtgacaaagccgttcggcgttatggagctgctttcgcgcgtgcgggccgttttgcgccgcgcgcggccggacgccgccgctgcgctctgccgctgcggtggcatcacgctcgacgccgggcggcgcgttgtcacggccaacggcgaggcggtgacgctgaccttcaaggagttcgaactgcttgcgtatctgatgaaaaacgagtgcatcgtcctgtcgcgtgagaaaatcatggaacgcgtttggggattcgactacgagggtgaaagccgcacagtcgacatgcatatcaaatcgctgcgccaaaagctcggtccctgcggggagctgatccgcaccgtgcgcggcgtgggctataaaattggcgattaaagggccgccgggaggacaatcaagatgaaaaaacgggtcttttggagtctctgctccatctctgtattgatggtactgctgacggcggcgctgacgctccgctcctattacgcggttttgctgggccaggcgcagcgcgatttggccgacgatttcaagctggtcgcgcgctccatcgattttacgcggccggatgaggtggcatatttgcagtcgctcggattgcagtttgacagcttccgcattacaatgatttcacccgacggcaccgtcctgttcgatacggacaatgacagcgcgtcgatggaaaaccatctcgaacggcccgaggttgcggccgcgctggacggcaggacgggcagcgatgtgcgccattccgatacaatggggatggatacggtttattatgcgggcaggctgtctgacggcacggttctgcgcgtctccaagcagacgcgcagcgtcggcgcggcgtttgcggcgggtgtgccggtgatgctggtgattgtggccgcggcgattgcaatctgcctgtttgtttcctcacgtctgacgcgccggcttctgcgtccgatcgaggcgctggccgacaatctggagcagggcgcgcgcggtgcggcctatgaggagctggagccgttttttgccaagatccgcgagcagaaccggttgattcaggagcaggtcaaacggctgcgcgaggagcgagacacaatcaacacgatcacctccaatatgaaggaggggatggtgctgcttgatttggaacgcggtatcctctctgtcaatcacagcgcgcttatgctgcttgatgcggccgagggcgtatatgagggtaaaaatatcctaaacctctcccgctctgaattgctcggagactgtgcgggaaaggcgctcgccggcgctgcggccgacgccgtgcttgagcgggacggacgcgcatgtcatatctttgcaagcccggtgcgcgacgcgggcggtgcgatctgcggcgcgattgtcctgctgctcgacgtgacggagcagcagcgcgccgaacaggtgcggcgcgactttgcggccaatgtgtcgcatgaactgaaaacgccgctcacatcgatttccggtttcgcggagatgatggaaaatggtatggccgataattctcaggatgtgcgccggtttgccgggcgtatctatacgcaggcgcagcgtttaattgcgctgacggacgacatcatccgtctgtcgcgcatcgaacgtgccgatctgacggagaatgtcccggttgagctgcgcgcgctatgcgaccgcgccgtcgaaacgctgcgtttcaccgccgaacaaaagcaggtggaaattgcggtgacaggaggacccgcgccagtgcgcggcgaccggcagatgctcgacgaactgattaccaatctgatggataacgccgtcaaatacaaccggccgggcgggcgcgtcgatgtgtctttatcagtccaggacgggttggtatgtctgcgggtagcggacacaggcatcgggattccgaaggaacaccaggagcgcatatttgaacggttttaccgcgtagatcaatcgcgctccaagcaaaccggcggcacagggcttggcctttcgattgtcaagcatgttgtcgagcgtcatggaggctcgatcacactggaatccgtgccaggagagggtacggccgtcacggtccggctgcccgccgacacaggacacatcggataagcaaaagattggtttgcgtaaacaatggctgaaaacgggcggtcccttttttaaggaccgcccgttttcagccattgggctttgcaaacaggtacgcaatacggtatcataaaatatatttataaaggagatgactgcatgttcagagaaatgcgccgcaagaaacaggagctttcccgcatggagagtgtcgcgctgctggagcgggcgacctccggcgtgcttgccgtattgggcgacggcgattacccgtatgccgttccattgagctttgtctattacgacgaaaagctttactttcactgcgccgtgaccggccacaagctggacgccgtcaaaagacatccgaaagcgtcgttctgtgtcatcgggcaggatcatgttctgccggaaaagtatacaacctgctttcgaagcgccattgcgttcgggcgcgtgcgcgtgctggaggacccggcagaaaagctgcatgcgctggagttgctggccgcgaagtattcgcctggccaggccgagggccgcaggcaggagatcgaccagcagtttgaccgggtgtgtatgctggaattatccatcgagcatctgaccggcaaagaggcgattgagctgacaaagcagcgccaggcgcgggaaaaagcgtaacgggccgccggcttatgccggcggcccgtttgatatgcatatgtaaaaccttaatataccagcgccacgaccaaaaacatgatggctgcctggacagcgatgcagccgattgtaatcccaatacaaatcggaagcgtatttttgccgtctgcacgcagcgaacgcgagatgcaaagggtgctgccaagcaggccgatcagcagaccgatgattcccgaaaagaaatagccgaggatcagcatcaaagcggtcatcacccaggcccaggccggcgtcttgccgacagggacatacttctcaccggagccgagatacacgccgtcgacagcgagatcagctttgctcccaatcatcacaaggttgagcaccttgtcctcgattctgatttcacggtcaagcagcatgatccagaaattctggctgcgcactttttcaacctgtccgtcgacaacaaccttgagcgcgccaaagccgcgtttgatctcaatggtgtgattctttccgttgaccgatacatcccacttggatattgccattgctaaaagtaccctcctaaggcgcatccattcagcgcccgttttttaccaattatatcataataaccgctttttagcaagattgtgacaactcggaaaacagatttattgcacagcgcgggccgtttatggaacgcttatccgcttgtttaacccgcctatccgagcatggtgagaaaacggctcggcccggccgggccgcgcccgcgccgcccgcgcgcccaggatacgaacagcttttttttggcgcgcgtgaccgacacataaaagacgcgcgcctcctcgtcaagcgcgccggagcgtagcgcctgccaggtgggaaatacgccctcctgcatcatcggcaaaaacacatagtcaaattcgcagccctttgactgatgcgccgtgatgacggcgaccttgttggctgttttgcgcatgcggtcaagcgcgcctggcgaaagcgccgccagctcgagcagcgcggcgagctgccgcgccggcggctgcgtgcagtcggtataatcgtcggccgcgccgtaaaacagttccaggttcgccaggcgcgccggctccgccgtgaacgcctcctccagcccgaacatccggcaggcgagccgcgcggcttcgggcgcggcgagcgcggcggtttttgcgcggacatccgccagcaggcgcgcgaacggctccaggcgcggcaggagcttttcgtaggccgcgcgccgcgccgtctcatacggcgcgacataccgctcgatcagcgcggccagcgcgtccgccgtggcgaggatgtcgtccatcgcgttatgcgacgggtcgtgcgccgcgccgagcgccgccgagacggtcgacagcttgtggttgggcaaatccttcatgtagcggcggctgatatcgagcgtgtcgtaccagacgttggagagcgtctgcacgctgcccgcgcgcgcaaggttctgggaagtgatcgtcaaatcgaacataacattgtgcccgaccaggacgcagcctttcgaaaagtcgaggaaatcctcgagcgcggcgcacggcgcgccgccgttttccgccagaaacgcgtcggagaagccgtgtacccgctcagacgcgccgacaggccgcgacggacacaggaaccgttcgaaacgcacggcttcgccgccgccgggcgagagacggacagccgcgatctgtacgatatcgtccgtataaacgtcggcaccggtgctttccacgtcgaacacgacgacgcgtccgtcaaaaaacgcctccagcagaccggcgaaaaagtcgccgtcgcggtgcgtgcgcagatcggccagatcgcatgggagcgcgccgctgtccgtgcgcggcagagccgccagcgcgcgcgccgtcgcttcgccgacgccggccgtatgacggcgcagcaggcgcagcatcgcagcgccgtcgcgcgggttggcaagcagggcgatacaggcgagcgcgtcctttacctcggcccgcgaaaagaggcgcagctcgtcggcgagcataaagcggacgggcgaccgcgctgcgtgcgcgccctggcagagcagttcgcacagctcggaacaggcccagttggagcgcgcgatgacggccgcgcgcgtgtagtcggttattccgagcgattcaattgactctaaaatccaggcggcttccgcttcgggcgtgtcaaaggcgcgtaccacgatatcggtacactgcggcgaggaaacgctgaagcggctgccgccgccgcggccaaaggctgccttcaggatgttttggccgacagcgagaagctggctgctgctgcggtaattgatcgtaaattccacacggacagggtggaaatccgcctcaaaacgcgcggcgagcgcggcagggtcggagccgcgccagccgtagattgtctggttgaagtctccgcagaacagtgtgaccgcgccgctgcatagacgggagagcaggctgtattccgcaaggctgacatcctgcgcttcgtcgacatgcgcaaagcgaaagcggccggtccatagctgcgcggtctgccggtcgcgcagcagggccgcggcgcggatgagcaggtcggagaaatcgagcgtgttgttctccaaaagcgtctgatcgtaaaggcgcgcgacggaagcgccgtattttgcgagaaaacggaaaaacttttcgtcatagcggcgctgttcgtcgacgcagatacgttcgacctgttcgcggcgggaaacgaatacggcggctgcggcttcggcgtgggagcgcgccggctcctcgagcatagcgtccttgacaagcccaataaaatcaagaagaatctgcgcgctgcgcccgtcgatttcccgaccgagcgtgcgttcgacggcgaggcgaacgatctcaagcgcgtcggctgcgtcgcagacggtgaaatcgcgtccgagatctgtgcgcgcggccggcgtctcgcgcagcatacgcgcgcaaaagctgtgcaccgtatgcacggccacgtcccgcgccgcttcgcccgcgaccgtttcaatacgttcgatcatttcgcggcaggcgcggtttgtaaaggtaaggcagaggatttcctccggcgccgcggcgccggagacgatcaggtttgccacacggcgcgcgagcgtatctgtttttccggttcccgcgccggcaagcagaaggatgctgtgcgccgtatccccgattacgacgcgctgttgttcgtttggtgcatgaagcgcccgcgccatggatggcgcgggcgcggggacgctcccggaaagggcggcggacatatcagcgttcctccctgaaatacgggttgccaagggcggccggcggctgattttcacgccgcttgccctggacgatcaacacaagcgcgacaattgtcataagatacggaatcatatcgagaagctgcgccgagacgcgaagttcaaatccaaagagattgagctgcgcgttttgcagcttgaatccgacgccgcgcagcgcgccgaagaaatacgcgccgaaaatggctttggccgggttccaggtggaaaagatgacaagcgcgacggcgatccagccgatgccggcggtgatattctcctgccagcgcggcacgaatacgatcgacagatacgcgccgcccatcccgcagagaaagccgcccgccacgatattaaggtacttgacaagcgtgacattgaccccggccgcgtcagccgcgccgggattttcaccgacggcgcgcgtcgaaaggccggcgtaggtgcgcgtcagatagatgtacaggagcaccgcgagcaccggcgcgatctgcacatagacgctctgctggaaaaacatttcgccgagcaccgggatttttgaaaggcccggcacattgtaggcggaaaaggcccgcaggatcgaattgggcagcgccagaccggccagcggtttgccgagcgtgccggacaggcccgtgccgaagatggtcagcgccagccccgtgacggtgtggttgccacgcagcgtcacggtgatgaccgcatagatcagcgcgccgaacgcgcccgccagccctgcgacggcgatggtcagaaatgggttgccggtgtgcagcgccgtcataaagccgaacacagcgcccatcagcatcatgccttcgacgccgagattgatatttccggatttctcgcacaggatgccgccaagcgtgccgaacaggatcggcgtgcccatctggacggcgacctgtaaaaacagagatacctgcgtcagtccgctcatttgaccgcctccttttcagagctttgcgtgcgcaccagacggtaatttaagaaaaattcactgcccaaaacgaaaaacaggatgacgccctgcaatatatccgctacggccgatggtacctgaagcgccgtctggatataggcgctgccctgaagcagcgcggcgaacagcagcgataccacgacgaccgccggcgcggacagacgcgccagccacgctgtgatgacggccgtgaagccaagccctgcggagagctggtcggtcagcgatttttcaattgctgaggcctgcatgaagccggctgcgccgcacagccctccgccgatcatcacggccgctgccgtaacgcctgccacggaaatgcccgcgtaacgggccgtcgtttcactttctccgatgacggaaatttcatatccgagctttgttttggccaacaggatatggacggccagcgccagaacaagcacaatgatccagccgatatgaacgccgaacagtttgggaagcacggccgcgtcgacgaatttgggcattttggcaaagccgcccgcgctcgggtccttccacgggccgtactgaagatacgtgatgaatttcgtcgccacatagttgagcatcaatgtgacgagaatctcgcttgtgcggaatttcgatttgaggactgccggaatgagcgcccacaggccgccgccgatcagggaggcggcaaacatcagcggcagaagcgccccggccggcagcgttttgaagtgataggccgtccatgtcgcgaacagagcgcccagataaaactgtccctccgcgccgatattccaaaatttcatcttaaagcatacagccacgccgagcgaaagcgtcgtcagcgggatggccttgacaatggtctgacggatacggtgcgccgtaccggtggaaccgacgatgatattggaaaaaacagcaacgggattgtagccgagcgccgccatgatcagcgacgcgcagacaagcgcggcaaaaacagccgccagacgtgtgacgatgtcgcgccggcgcgacgggtccggacgccgtacaatgcggatcatgcgaccacctccccgggtttatggccgagcatcatcagcccgatatcctctttggtgacctgcgccggatcgacgatgcccataaccgcgccgccatggatgaccataacgcggtcgcacagctccatcagcacatcgaggtcctcgccgatgaacaggatgccgacgcccttttccttctgtttgttcagcgcgtcataaataaaataggaagcgccgatatcaagcccgcgcacaggataggcggttataagcagcgttgggttcagatcaatttcacgtccgagcagcaccttctggatattgccgcccgacagctttttgacgatgtggccgaccgacggcgtgtcgatggaataatcacgcacaatgcgttcggcgtcccgccggccggaggaacggtcgataaacggcgttttgccgcgccggaaggttttgagcatcacgttctcaacgatgtccatacccgcgacaagccccatgccgaggcggtcctccgggataaagctcatctgaatgccgcgcctgatgatctcggccggcggcttgccgagaatcgattcgccctggaacacgatctcgccggacgaagcgcgctgcataccggcaatgatctcgcacagctccttctggccgctgccggcgataccggccacgccgagtatttcgccgccggagagcgtaaagctcataccgtcgagcgtcttgacgccgcccggcccgcgcgccgaaaggccgcgcacctcgagcagcgggcgcttcagctcctgagggacggcgggacgcgcgatcttgagcgagacgggccgcccgaccatcagctcagtcagagagcgggcgtcggcgtccttcgtctcgaccgtgccgaccgactcgccgcggcgcagcacggtcacacggtcgctgatctcaagcacctcgcccagcttatgggtgatgatgatgacggagcagccctccgccttcatgccgcgcaggatctcaaagagactttttgtctcctgcggcgtaagcaccgccgtcggctcgtcgaggatcaacacatttgcgccgtggtaaagggctttgaggatttcaaccgtctgcttttctccgacggacatgttgtaaaccttgcgctcagggtcaaccgtcaggccgtagcgggcgccaagcgctttcatccgcgcggcgagcgcgcgcttatttacaaacagcccgccgcgtgcgccgagcgcaagattttcggcagcggtcatcacatcgacaagcttgaaatgctggtgcaccatgccgatgccggactcaatcgcatcgcgcggcgaagcgaagcgccgcttgcgtccgtccacgacgatctggccgctgtccggcgcatagatgccggagagcatattgacaagcgtgctcttgcctgatccgttttcaccaagcagcgcgtgaatttcaccgcgtctgacatccagacagacgttgtggttggcgcggacactgccgaacgatttgcagatatcggtcagttggatatagggcgcgcaatccatgttggaacctccttattttgctgatggcaggccgcccgaaaaggcgaatgggcgggagagggaaaagaaggggcggggcatggccccgccccttcggtggaacggaaaagtttaggcggcggggacggtgccaacaatgttgtcaacaaaccagtcgaacgcaagcagctcggcgtcggtcatttcggagccggcgggcacgcgctcggcgcccgtgttgtcgctgatcgggccggcaaagattttcagctcgccggattcaatcttggcgtacgcctcgtcgattttctcctgcgtaccctcggcgcaattggcggaaagctcgtcaaggtagacaatgccgtccttcatatcgccccaatagttctgcgaggtccaggtgccgtcgatgatcttctgcacctcggcggtgtaataggaaccccaatcccacagcggggcggtcatatacgcctgcggcgcgacatcgtaggtggccgcgttgtagccgatcgcgaacgcgcccttctcctgggcggcgacctgcggcgcggtcgtgtcgacgtgctggccgatcacatcgcagccggaattgagcaggtcgatcgcaacgtttttctcaccggcgggatcgtaccaggaattggtgaacttgacttcgacggtcgcgtccggattgacggatttgacgcccagtgcgaacgcgttcgcaccgcgcacaacctcggcggtcggcatggcggcgacatagccgattttgttcgattccgtcttgaggccggcggcgatgccggtcagatagcggatttgatacatacgaccaaaataggcggtcatgttttcgccgtagcggaatcccgagcagtgttcaaagatcacgtccggatactccttggcaacctccatcacccagtcctgatgaccgaagcttgtcgcaaagataacgttgcagccctggtcgatcaggttgcgcacctggtcggcgcattcggattcctccgggacattttcaacgatcagcgtctgatcttcggccagaccgagcgtttcggccatcttggcgcggccctggtcatgcgcgtaggagtaaccctcgtcgccgaccggaccgacatagagaaatccaattttcaagtcttcctttgcaatcgccgggaaggtctttgtaccgacctttgcagcccaatcgtcggccggtgcggcttcggaagcggcggcctcgccgccgtcagccggagcggaagcagcgggcgcggaagcggccgcgccgccggcagtggaagcggccggctcggagcctgcgcacgcggcggcagaggccgccattgccccggcaagcagcagggcaaggatctttttgctcagtttcattttttctcctccaattttaacattccccgcttgttatgcgggttcttattccaaaacacagccgcgcccgccgtgcagcgggcgcggccgcgtggaaaacacacggagtcggatcatgaaagaaaatcgaccgcgtcagtcgcggaaaaggatctcgccggttttgtcgtccatgctctccacgatggcgagcgattcgacacgcacgccgcgtccgcggatgagcgcgccgccctcctgaaagcccttttcaattacaatgcccgcgccgacaagcgttgcgccagagtcctcgacaagcttgcacagcccttcgagcgcgctgccctttgcgagaaaatcgtcgatcagcagaacgcggtcgtccggcagcaggaatttcttcgaaacgatgatgtcgtaaacgcgcccgtgcgtgaaggattccacgcgcgaggtgaacacctcaccgtcgatgtttttcgactgcgactttttggcaaacacaaccgggacgttaaaaaactgcgccgttacagccgcaatcccgatgccggaggcctcgatggtcaggattttcgtcacgccgcagtcgccgaacagacgcttaaactcctgcccgatctcacaaaagagagaaatatccatctgatggttgagaaagctgtcaaccttgagcacattgccggctttaacaaggccgtccgcgcggatgcgctgtttcaaaagctccatttccgtcgatcctccaaattgcgttcttctcccggaaaaaggggaaacgtatacattcagtttacaggaaattcacagattgttcaatggggtaaaaagtgcagaaaaagaatacacaggacacggcggttttgacaggtcctacaaaattcgacctaaaaaatgataagtattacttaaaaatgtgcagaaagttgtctgtatcgggcgcatatttgtattgcatgaaactgccaaagcgtgtacaataaataaaaaccgccaccgcggactataaggaggatcgtgatgaacgaacagatcaagcagatcgcagggcgcatccgcgaactgcgggagattctcgatgtagcggctatcgatctggcaaagcagctgaatctgtcgcccgaggagtatgaacggtatgaaaacgccgaggacgatatccccatcggcgttatatatggcgtagcggcggcgctcaacgtagacccgacggttcttttgaccggcgaggcgccgcgtatgaacgattacacaattgtgcgtcaggggcgcggcgtttcggtcgagcggtataagggctaccggttcaattcactcgccttcaattacatagaccgcgactttgatccgatgatcgtcgacctcgagccgatggaaaatccgcccgagcttgtgacgcatgcgggtcaggagtttaattatgtgatcagcggcacggtgcagcttgtgatcggcagccgttcgtttctgctgaaagccggcgacagcgcctttttcaatccgtcaactccgcatgggcagcgcgccgtggacggcccggtccgttttctgaccatcatcaacgaataagaacctgctccaaaggcggaataaagaagggtgtatatgatcgaaaaatttctgcctcgtacgcagttcgattcgtacgaggattttaaggcgaattaccggctgaatatcccggagaacttcaatttttcatacgatgtgatcgacgagtgggcgcgccgggacgcaaaaaagcccgcgctcgtctgggtggacggcggcgcgggcgagcggcggctcaccttcgcggagctgtcggcgctttcgatgcaggcagccaattttttcacggcgcacggcgtgcaaaagggcgatttcgttctgctggtgctcaagcagcgcgtcgaggcgtgggtgtgcatgctggcgctgcaccgcatcggcgcgatcgtgatcccggcgaccttccagctcatgccgcacgatattgaataccgctgcaacaaggcgggcatcaagatgatctgctgcgtcgacgacggagaactgctcggcaacatccggcaggtgcgcgcggcatgtacgacgcttcggcacgttgcggttgtcggtgaaacaatccccgcggactgcatcgatttccgtcgcgccgtcgcggactacccgacggattttgcgcgccccgcaggcgaagcggcgacggatgtccacgacctgatgcttggatatttcacctccggcacaaccgggatgccaaagctgatcgttcacgattacgcctatccgctcggccacatcacaacggccaactactggcatgaggtgcgcgacggcgggctgcatttcgtttcggccgactccgggtgggcgaaattcggatggggcaagatttacggccagtggatctgcggcgcggtcatcgtggcgtatgataccgaagggaaatttgatccggtgcatatgctccagacgattgaacgcctgcgcccggcgacgttctgcgcgccgccgaccgtgtaccgctttctgatcaaggaggacctgtcgaaatacgacctgtcgtcgctgaaaaagtgcacgatcgcgggcgaaccgctcaaccccgaggtctttaaccgctttaaagaggcgaccggccttgaattgacggagggcttcggtcagtcggagacgacggtcatcatcgccaatttcccgtggtttccgatcaagcccggttcgaccgggaagttttcgccgctgtacgatttggacattgtcgacgaggacggcaattcctgcgaggacggcatcgtcggcacaatcgtggtcaaaaatcttgacaagggccggcctgccggcctgctcatcgagtaccgtgacgacccggaggcgaacgcggccgctttttatgacaacatgtattcgaccggcgacacggcctggcgcgatggggacgggtatatctggtttgtcgggcgcaacgacgacgtcatcaaatgttccggctaccgcatcggtccgtttgaggtcgaatcggcgctgatgacgcacccggcggtgctcgagtgcgccgtcacggccgcgcccgaccctgtccgcggccaggtggtcaaggcgacggtcgtgctcgcgcgcggcgttacgccctccgacgcgctcaaaaaggagctgcagaaccatgtcaagaaggagacggcgccgtataaatacccgcgcatcgtcgaattcgtggacgagctgcccaagacgatgagcggcaagatcaagcgcaagcagatccgtatggaggaccacgagaaggcggcgaggtagcgtgcgttttggccgccgcggcgcctcggggacgctcaaacggcccggctgatatgaaaaaactgcgcaggggcctgtcaaaccggcgaaagatgcttgcattttgcgcgcgggtatgctacactgacgttatggtaagaatagaaacgattgtgaaagagtgaggtcagcctcactctttcctttgcgtatggagggatttggtggcaaaggcccagggaaaacgcccgaataccgccgccgtctgcgaggcgctggccgcgccggtcgcacagcgcatggggctgtatctgtgggacgtggcgtttgaaaaggagggcgcgggatggtacctgcgctattatatcgaccgtgagggcggcgtcacgatcgacgaatgcgaggcgttcagccgcgaggtgagcgacctgctcgacgaggccgatccaatcgaccaaagctatacgcttgaggtcggctctcccggagtggagcgaaagctcacaaaggactggcattttcaaaaatatatcggcgctcaggtgcatgtgcgcctgatccggccggtcgagggcgagcgcgattttgtcggcgcgctttcgtcgtatgaaaacggcgtggtcgccgtgctgctcgacgacgaattggagatgaccttctcgcccggcgagacggcctttgtccgcctttatgaagaattttgacgctgcgacggcgtgcattatatattgatgggggaatccggaaaaatgaatacgagcaataccgagtttttcgaagcgcttgcgctgatggaaaaggaaaagggcataccgcgcagcctgcttgccgaaaagatcgccacggcgatcggcaacgccatccgccgcgacatgggcgcttcggaggacagcgtcgtcgatatcaacccggatacggggcgcttttatgtcgcgatgcgcaaaacggttgtagacgacctgctcgaccccgcgcaggagattctgccggaggaggctgtcaaatacgacagcggcgccatgctcggcgacattgttgaaatcccgcttgacaccaagcaattcgggcgcatcgccgcgcagacagccaagcacgtcatccgccagggtatccgcgaggccgagcgcgggcagcttttcgctgagttttcctcgcgccagcacgatattgtgacagctaccgtgttgcgcaccgatcaggtcaggggcaacgtcacgctggagcttgggaaaagcgaggccgtgctgcccaagggcgagcaggtgccgggggaggaatatgccgacggcgcgcgcatcaaggtctatgtcgtcgatgtggtcaacggtgaaaaaggcccgcgcatcatgatttcccgcacgcacccggggctggtcaagcgcctgtttgagatggaggtcccggagattttcgacggcacgatcgaggtcaaatcaatctcgcgcgaggccggctcgcgcacgaaaatcgccgtttggagcaacgacgagaacgtcgaccccgtcggcgcgtgcatcggtccgaaggggcagcgcgtctccgctatcgttgaggagcttggcggcgaaaagatcgacgttgtgcgctattcggccgacccggccgaattcatcgccgcggcgttgtcgccggcggacgtcgtctcggtcgaggtcgacccggacggggccaaaagctgccgcgtttcggtgccggaccaccagctttcgctggccatcggcaacaaggggcagaacgcgcgcctggcggccaagctgacgggatggaaaatcgatatcaagccggaaagcggcttttacggcgaataaaatgccatgacgcgcgcgggcgtatcccgcgcttacgggaggaatcgcgatgcagaaaaaacagccggtgcgcatgtgctccggatgcgccgcccacaggcccaagagagagcttgtgcgcgtggtgcgcacgcctgaagggacgattttgctcgatccgggcggcaagaaatcgggacgcggcgcttatttatgtcctgacgccgcctgtctgaaaaaagcgaggaaggcccggcggctggagcgcgcgctcgactgtgcgattcccgacgaggtgtatgcgcgcctggagcaggaattgggggagacgccgcatgaatgaccggctgttttcggcaatttcgctctgccgcaaggcgcggcggcttcgtatgggcgccgatgtggtgcgcgacaacgtcctgtccggcgaggcgaagctggtgcttctcacaagcgacatcgccgaacgctccgcgcgccatgcgcgcggcatatgcggtccggcgcacgtgccggtgcgcacgcttccatacacgatgcaggagttagccccggttgcgggtaagcattacggcgtgttcgcggtctgcgaccgcggcttcgctgatatgattttggggcttttgcccgacggtacggcgtaatcaaccgatatggtctttatatagagaatccagcgttccaactccgcggcggcgcctgtggtttgcgaacgtcacggcggcaggcagccgcgaatgatcagaggaggaattcaacgaatgatcgaaaagtacaggttgcacgaggtcgcaaaggacctcggcgtagcgagcaaggaggtcgtcgacctgcttgcggagcgtattccgggcgagcgcaaaagcatgaccgccctcaacgagcaggaattgagcgttgtgctcaaccactacacgaatcagaaccaggtggagagcttcgacgaatattttgcggccggtgaggcaaagaagcaggcggcaaaagaagccgcgcgcaaggcggccgagcaggcgcgcgcggccgcgcaggaggccgcccgcaaaacggcggaggaagccgcgcgcaaggccgcgccggcgcagcagccggccgcgcagcagggcggccagggccgggcgcagcagagccagcagcgcccgcagcagggccagagccgttcacagcagggccagcagaacggccgcacccagggccgggcgcagcagggcagccagcagcgtccgcagcagggccagggacgcccgcagcagggccagcagaacggccgcgcccagggccgggcgcagcaaggcggccagcagcgtccgcagcagggccagggacgcccgcagcagcagcgcccgcagcagggcggccagccggcttcgtcggcgcagcagccggggacaaagccgcgccagcgcgggtcggcgatggtcgatatgcgcgccggctccacgcaggtggagcttgaccgctacaacgagaaatacgacacgcttgcccagacaaagatgggcaaccgcgatacgggcgcgcagaagcagaagctgacgcagcgcagcgcacagcgccgttcgggcaagccggccatgtcccgcaaggagaaggaggacgcgaagatgcgccggctcgagctggagcgccagcgccgccagaagctggagattaccatcccggacgagatcaccgtcggcgagctggccgcgcgcctgcatctgacggcctccgaggttatcaagcgtctgatggggcttggcgtcatggcagctgtcaacgacgtgatcgattacgacacggccgcgatggtttccatggagatcggcgccaaggttgaaaaagaggtcgttgtcacgatcgaggatcgcctgtttaaggtggacgaggaggacggcgacgaaaacctcgtcgaacgcccgccgattgtggtcgttatgggccatgtcgaccacggaaaaacatccctgctcgacgccatccgccagacgaacgtcaccgagggcgaggccggcggcatcacgcagcacatcggcgcgtatcaggtcgaggtcaacggccgcccggtcacattcctcgacacgcccggccacgccgcctttacggccatgcgcgcgcgcggcgcgcaggtcacggatatcgcggtgctcgtcgtcgcggccgacgacggcattatgccgcagaccatcgaggcgatcaaccacgccaaggctgcgggtgtttcgatcatcgttgcgatcaacaagatggataagccgcacgccaatcccgacaaggtcatgcaggaactgacggaatatgaactcgtgcccgaggcgtggggcggcgacgttccgtgcatcccggtttccgccaagacgcgggagggcatcgaggacctgctggagatgatacagcttgtggccgatacgaacgagctgaaggccaaccccgaccgcgcggcgcgcggaacggttgtcgaggcgaagctcgaccgcggccgcggcccggttgcgacgatccttgtgcagaccggtacgctcaatgtgggcgacgcggtcatcgcggggacgacgttcggccgtgtgcgcgtcatgctcaacgacaagggcgagcgcgtcgagcacgccggcccgtccatgccggtcgagatcacgggcctgggcgatgtgccggccgcgggcgacgtgctcaacgccgtcgctgacgagcgcctggccaaggagcttgtcgaccagcgcaagcacgagcagaagcaggaacagttcagttcctatgagaaggtgacgcttgacaacctgttcagccatatctcgcagggcgacgtcaaggaactgccggtcatcgtcaaagccgatgtgcagggttcggtcgaggcggtgcgccagtcgcttgagaagctttcaaacgacgaggtgcgcgtcaaggtcatccacggcgcggtcggcgcgatctcggagagcgacgtcatgcttgccgacgcctccaatgcgattattgtcggcttcaatgtgcgccccgaccccgtcgccaaggagaacgcggagcgcgacggcgtggagctgcgcctctaccgcattatttacgacgcgatcaacgatgttgagacagccatgaaggggatgctcgcgcccaagacgcgcgaggtcgaccttggacgcgcggaggtgcgccaggtctacaagatcacgggcgtcggcgcggtcgccggctgttatgtgcttgagggcaagatcacgcgttcggccgagatccgcgtcgtgcgcgacggcatcatcatcgccgacgacaagcttgcgtcgctcaagcggttcaaggacgacgtgaaagaggtcgccaaggggtatgaatgcggcatgggccttacaaaattcaatgatatcaaggaaggcgatatcttcgaagcgtatgagattgaggaatatcgcgaataataaccggacggggctgcccgcgccgggcgggcgcccggcgtaagaagcgatcaaaaggagaacatgtatggccacattcagggcctcccgcacggaggaggacatccacagggagctttgcgacatcatgcgcggcctgaaggacccgcgcgtttcgggactgatctcgatcgtcaagctggatttggcgcgcgatctgtcccactgcaaggtctatatcagttcgatggacgggatcgcggcggccaaaagcgccgccgcggggctgcgcagcgcgcagggatttatcaagcgtgaactaaacgcgcgcttgaagctgcgcaagctgccggaattttcgtttatcgcggacgattcgatcgcccacagcgcggatatcgcgcgcattctggacggtctgcacacacaggatcaggagcattgacaaggagggaacggcatggcgcaggcggtcaacgaacggcaggcggcggcgctgctcgcgcagtcggaccggattttgatcctttgccatcaaaaaccggacggggatacgctcggcagcggtttcgcgctgctctacgcccttttggcgatgggcaaaacggcgcgcatcgcctgcccggacggtttccctccgcgctattgcttcctctatccgggctttgtccctgaaaggcagcccgactttacgccgtcgtgcattgtcgcggtcgatgtggccgacctgcagctgctcggcgcgtgggccggccgcctagccgggaagattgatctgtgcatcgaccaccacccgtcgaacacgggctatgccgcgcggctgctgctcgacgcgaaggcggccgccacggtcgagatcatcgaccgtgtgctgagggagcttggcgcgcaggtcgattaccgcatcgccgtctgcatctacacggggcttgcgaccgatacggggtgctttcgttattcaaacacgacgcccgcctcgcacctgctggccgcgcggatgatggagcacggcatcgacagctaccgcatcaacaagctgatgttcgagacaaaatcgccggcgcgtatggagcttgagcgcatggtgatggacacgcttgaatactacgaaaacaagaggatcgcgtttattgccatgacgctcgacgccatcgaaaaaaccggcgttcccgaggaggatatggaaggcatcgccgcgatcccgcgccagatcgagggcgtcgacgcggcggtgacgttccagcagaagggcccggaacgctggcgcgtttccatgcgcagcagccaatatgtcgatgcatcggccgcctgcgcgcgtctgggcggcggcggccacgcgcgcgccgcgggctgtacgctggaggggacgcttgaggcggccaaggcgcgcgtgctcggcgtgctcagggacgttttaggcacgcaggacagcctgaaggcggaaggttcccaagggggaaaggatttggtcgtttgacagagcaaggcggaattttatgtattgacaagccggaaggctttacatcatttgacgtcgtcgcaaagctgcgcgggattgcgcgggagcggcgcgtgggccacgcggggacgctcgatccgatggcgacgggcgtgctcccgctttttttcggccgcgccacaaaggcgtgcgatatcctgccgcggcaggacaagcggtacctggcatcgtttaagctgggcgtaacgacggacacgcaggatatcaccggcacggtgctcagtgagcagacgccggacgccgacgaggcgcgggtgcgcgcggccgcggccggcctggtcggggatattatgcagacgccgccgatgtattccgcggtgcgtgtgaacggacagcgcctttacgagctggcgcgtcggggcgtcgaggtggagcgtgccgcgcgtcccgtgacggtgtattcgatcgattttacggcgtgcgacgtacaggcgaatacctttacaatcgatgtgcactgttccaaggggacgtacatccgcacgctgatcgccgatatcggcgcggcgctcggctgcggcgcggtgatgaccgcgctgcggcgcacgatggccgcgagctttacgctggcggactgcgtgacgattgaacaggcgcagcaggccgctcaggacggcgtgttcggcacgctgctgcgtccggtggagacggcgttttgcgcgctgcccagtgcggcgctcaacgagaagcagacaaagatgtttttaaacggtgtgcggctcgatatcgggcgcgtcgcctgcaagcggaccggtgatacatacgccgtatatgcgcatgaccgccgctttctgggcgttgcgcgggaacgagacggcctgctctgtatgcagaagctgtttacgctggaggtgtaggccctttggaggtatttcacacgattgcacaggccgccgccggcgcgccggcggcggttgcgtgcggctattttgacgggctgcacatcggccacgccgcggtggtcggccgtgccgtgcagcgtgccaaagaggaggggctttgcgcgggggtgtttacctttacacgcgctggcggcagccccgaacgcaagaccggcgcgggggagatcgtcacggaagcggataaatatgcgatcctggacgcatggggcgtgcagcgtgtgctcgcgcccgacttctccgaatttcacaacctggagccggaggaattttttgacgaggtgcttgtgcgccgcatgggcgcgcgcgttgtctgctgcggggcggatttccggtttggacgcgcggccgccggcggcgcggcgctgctcgaaaagctgtgcgcgtcgcgcggcgtcgcgcttgagatcgtgccggaggtgctctgcggcggcgtgcgcgtaagcagcacgcgcatccgggagctgctcgccgccggcgacgttaaagaggcggggcggctgctcgggcgggccttcggctatcgcctgactgtggtacatggaaaacggcttggacgaacaatcgattcgccgacgatcaaccagcgtttccctaaatcgtttgtgcgcctgcgccacggcgtttacgcggccgctgcggtcgtggacggcgcgctgctgccggccgttgcgaacatcgggctgcgcccgaccgtcgagcagacggacgccgtgaattccgagacgtatatcatcggcttttcgggcgatttatacggccggcagatcgaggtgcgcctgctggagtttctgcgcgacgagcagaagtttgcgtcggtcgacgcgctgcgcgcgcgcatccaggcagatgcgcgcgcgtccgtgccgattgccggggcatatattgaaaaaacaggcaaataaaggcgcatgcgccctttactttctggaaacactatggtataatgaaaaatcgatatggcctttttcacggaggcaggaccaaaacgcctgtgtcacaggcttaaagccctggccgactgccgttgggaattcacccgcctgtctctgagattgaggactgaataaagaaaggtgattgacatgatccgtaaggaagaaaagcaggaaattatccagaacaacgcccagcatgagggcgacaccggttcgccggaggtccagatcgcgatcctgaccaagcgcatcgccgacctgaccgagcatctcaaaacacataagaaggaccatcacagccgccgcggcctgctgcgcatggttggtaaaagaaggaacatgctcaactacctggccaagaaggacatcaaccgctaccgcgatctgatcgccaagctcggcctgcgtaagtaagcgataccacacggaaggcaggcggagcagcggtccgcctgccttccctcgcatcaccccgcgcgtgcgcgggggtaaaaacggaaaccgcgggaatgctttttagcagttatctggacgcccgggcgccgggcgccgagatacttgctaaaagacacgcggcttccgtaaatgaaaatttgtaaacggaggtactgcaatgtttgaaaactacaaggtttatgaaatcgaatacggcgggaaaaagatgacgtttgagacgggcaagatgtgctgcctgtcgaacgcttcggtgctggtgcgctggggcgaaacggttgtactcgtcaatgtgaccgcctcggccaagccgcgcgaaggcatcgacttcttcccgctttccgtcgattttgaggaaaagctttacgctgtcggcaagatccccggctcgttcatcaagcgcgagtcgcgtccgtccgacaaggcgatcctgtcctcgcgcctcgtcgaccggccgatccgcccgctgttcccgaaggatatgcgcaacgactgttcggtcgtcatgaccgtcatgtcggtcgatcccgactgcctgccggagatcgccggcatggtcggcacttcgttcgcgctgtcgatttccgacatcccgtggaacgggccgattgccggcatcaatgtgggccttgtcgacggcgagatcatcgtcagcccggacgctgcccagcgcgcaaagagcgatctgaacctgactgtggccgctaacgaggatgtaatctgcatgatcgaggcgggcgcgaacgaggttgccaacgatgtgatgctcgacgcgatcatcaagggccacgaggagatcaagcgcatggtcgcgttcattaagaacgtccaggccgaaatcggcaagcccaagttctcgttccagtcgatggaggtcccgcacgagctgttcgacgcgatcagggattttgcaatcgacgatgttaaggccgcgctcgacaccgataacaagaacgtgcgcgatgagcgcctggcgccggttgtcgagcgcatccatgagaagtttgacgacgaggaaaagacgaacgcagcggtaattgatgaagcgatctacaagcttcaaaagttcattgtccgccgctggctgctcgatgaacagaagcgtgtcgacggacgcaaaatggacgagatccgcccgctggccgcggaggtcggcctgttgccgcgcgtgcacggttccggtatgtttacgcgcggtcagacacaggtgttgaccgttgccacgctcggtacgatcagcgaagcgcagaagctcgacggcatcgacgatcaggagcagaagcgttatattcatcactataacttcccgtcctattctgtcggcgagacgcgcccgagccgcggcccgggccgccgcgagatcggacatggcgcgcttgcggagcgcgcgcttgagccggtaattccgccggtcgaagaattcccgtatacaatccgccttgtttccgaggtgctttcctcaaacggctcgacgtcacagggttcgatctgcggctctacgctggcgctgatggacgcgggcgtgccgatcaagcgcccggtcgccggcatttcctgcggcctgattaccgagggcgaccgctggatgaccatggtcgatatccaggggcttgaggactttttcggcgacatggacttcaaggtcggcggtactgaaaaaggcatcacagccatccagatggatttgaagatcgtgggcctgacgtatgatatcatccgcgaggcgtttgaaaagacgtataaggcgcgcatgtacatcctcaacgacatcatgctgccggttatccccgcgccgcgcgaggaactttccaaatatgctcccaagatgaagtcgatcaagatccatccggataagatccgcgaggtcatcggttcgggcggcaaggtcatccagaagatttgcgcagactgcaacgtcaagatcgatatcaacgacgacggcgatgtgtttgtcgcgggtaccgattccgacggcgtgcgccgcgcgctttcgatcattgagacgatcgtcaacgatccggagatcggcgcgatctataagggccgcgtcacacggctgatgaacttcggcgcgttcgttgagcttgcccccggcaaggagggaatggtgcatatctccaagctcgatatgggccgcgttgaaaaggtcgaggacgtcgtcgccgtgggcgacgaggtgatcgtcaaggtgacggatatcgatcagcagggacgcatcaacctctcccgccgcgatgcgctcattgcgatggaagcgaagaaaaacgctgcaaagcagtaagcctttacagtttgccgctatacgctatactcaataaagtcagaacgcccggtaacgaatgcttcgttaccgggcgtttgcagaaagcgcgctgaacgccatggcgcataacagcgggaattgaattttcggtaaacatatgataaaatcgattgtagcaggccacattatttggtatgataaatggtatcgtggttatgcgcaggaaaagaaacggtttatttgtattattatgtctaaaaaatactatatgtaatttcgggggttggttttttcttggacagtacaagcggcatattatacttggttttgctggcattgctcgcattttcggcatttttttcggccagcgagacagcgtattcctcactcaacaaaatccgcatgaaaaattatgccgacgcgggcaaccgcaaggcgcgccgcgcgctttatgtagcggatgatttcgaccggctgctgtcaaccattctggtcggcaacaacgtggtcaatatggccagcgcctccatcgcgacggtcgttgcgacagcgatgttcggggccagcggtgcggcggtcgcgacggtcgtcatgacggtgcttgtgctgatcttcggggagattctgcctaagacgcttgcaaaggaaaacagcgaaaacatcgcgatggccgccggcgggctgctgtcgtttcttataaagctgctcagtccaatcgtattcttttttgtaaagatcaaggagcttgctctgcggcttgtcaaggggccggcggcacagccgtccgtcactgaggaggagctgaaatacattgtcgaatcgatcgagcaggagggcgtgcttgaggaacaggagagcgaccttgtacagtcggcgcttgacttcgacgagataaccgcccaggagatcctcacgccgcgcgtcgaccttgtgacgctcgatgtcgaggattccatcgacgaggcgctcaaggtggtgcttgacgcgcattattcgcgtatcccggtttaccgcggaactgttgacagcatcatcggcgttctgcaggtgcgcgatctgctcaaagcggtcgtcaccggacgccagacacaactggatcatttgatttccgattgtgtttttgtgcataagacgatgaaaatctccgcccttctcgcggagttcaaggcgaagaagctgcatctggccgttgtgaccgacgactatggcggcacgatgggcatcgttacaatggaggatgtgcttgagcagcttgtcggcgacatctgggacgagagcgacgaggttcaccatgattttgtacagacgggtccggacacatatctggtcagcggggatatgaatgtattttccatgcttgaggagcttgaggaggacgaccgcgatttcgacagcgattataacactgccggcggctgggcgcttgagatgctcgggcatattccgtcggcaggcgaacaatatgccttccgcgatctgcgcgtgacggttgtcgccgtcgaggagcagcgtatcctttcgctgcgcgtcgagaagcttttgccgcctgatgaagctgataccggcagggacgcggaaaaataagaaccggccgcttaggccgttcgggggagcaaacagaatgagggattttacaaataccgggcgtattgtcgtcaaggtcggatcgtcgacgctgacacatgaaagcggcctgctgaatatccggcgtgttgaacagcttgtcaaggtgcttgccgacatcaaaaacagcggcagacaggtcgtattggtcagctcgggcgcgcaggcagtcggcgtgggcaagctgggcctgcataaaaaaccgggcgacatgcccggcaagcaggccgtcgcggctgtgggacagtgtgaattgatgtacatatacgataagctgttcgccgaatatcaccatgtgaccgcgcagattcttttgacacgcgacgttgtggacgacgccgcgcgcaaacagaacgcgcagaatacgctttgccgcctgctcgatatgggcgctttgccgatcgtcaatgaaaatgactctgtttccacagaggagattgaattcggcgacaacgatacgctgtcggcgatggtcgcggcgcttgccggcgcggatctgctggtgattttaagcgatatcgacgggctttatgacgacaatccacgtacaaatccaaatgcgaatctgctgcacgaggtcgcgcggatcacgccggagatcgaggcgtgcgcggccggcgcgggcagcgcgcgcggtacgggcggcatggtgacaaaaatccatgccgcacagattgcggtgcagaatgggatcggtatggttatcatgaacggcgcttctccgaaaaaactgtatgatctgtttgaaggccgtgatgtgggaacatatttccctgcatcccgcaaataggcggtctgcattttgggggccgttgtgaatgaatttaaaagggggtctggcttatgaacagcctgctggaaacaggtaaacgggcgcgcgccgcttcgcgcgtgcttggctgtacaacaacagcgcagcgcaacgatgcgctgtatgcggtcgcggatacgcttgacgcgcactgtacagacattctcacggagaatgaaaaggatcttgcggcggcgcgcagcaatgggatgacagaatcgctgcaagaccgtctgcggcttaccgaggaacgcattgcatccatcgcgggagctgtgcgcttcgtggccaagctcgaagacccggtcggccgtgtgctcggcggcgggagccgcccgaacggtcttaaaatcgaaaaggtgagcgttccgctcggcgtagtcggcatgatctatgaggcgcgcccgaacgtcacggtcgacgcggcggcgctctgccttaaatcggccaacgcatgtatcctgcgcggcggcaaggaggccatctgctccaatatggcgtttgccaatttgatgcgggatgcaatcgagacggcgggcctgccgcgcgactgtgtgcagcttgtggaggatacgacgcgtgcctccgccgccgacctgatgacgctcgacggctatctcgacgcgctgatcccgcgcggcggcaagggactgatccgctcggtcgttgaaaacgcaagcgtgcctgtcatcgagacgggggcgggcaactgccatatctatgtggacgcttcggccgaccttgagatggctgtgcgcatctgcgacaatgcaaagacctcgcggccgtctgtctgcaacgcggttgagacggtgcttgttcacagagatatcgcgccggcgttcctgccgcgcttaaaggccgcgctcgacagccatgccgtcgagctgcgcggctgcgtgcgcacggccgccctgatcggcggcgtcgtgccggcgactgaacttgattatgcgacggaatttgacgactatatcctcgcgctgcgcgttgtggacagtctggatgaagcaatcgagcatattcagaagtatacgacaggccattccgaggcgatattaacaaacgattataccaacgcccaagcctttaccgcccgcgttgacgcggcggctgtctatatcaacgcgtcaacgcgtttcaccgatggaggcgaatttggtttcggcgcagaaatcggcatttcaacgcagaagctccatgcgcgcggcccgatggggttggcggagctgtgctcctgcaaatatatcgtgaccggcaacggtcaaatccgctgaatgcatttgaaaggaatctggcatggataaaagaaaaaagctgcaaaaggcagccctgcgtgaaatgcaggaggaggtacgcttccggcggcataaatacgtcgccccggtggggatcgtattcctgctgctcgcggcggttggtcttgttacggtgtgcgtgttctgcgtgcggtttacacagcggctgcttgacaacagcgctgaaaaagcacggtttgagcaggtcattacgcccgttctgatgcttgacccggttccgtttggcagcgccgctgacgcggacccgctgtttctgttgcaatcgtcgctgtggagcgcgctgctcggcgacaagcgtgagagctatcaggccaatgaggactcgctcggccgcattccggtgccggcttccgatgtggatgtcgcggctgcgcggctttatggagacgtcaagctggagcatcagtcgtttacggttaactatgtcgacaactatgtctatgatgaggataccaagacgtattatgtccaggtgacaggccaggtggggctgtatacgccgaacgttgaggagattgtcaagaagggaaatcaatatactctgctggtcggctatgtgccgcccaacgatgtttggcggcagagcgccaccggtaagacagaacggccgcagtccgataaatggatgtattatgatctggagagggtcggcgaccattatcagattctcgccattcgtgatatcccggtcgagctgcgcaataagctgcttgagcgcgacggccagccgattccgacacagcttgcgggcgatgctgtacccgctgcgtaatggatagattcagaacaaaaaacccgccgcggccctgatgggctgcggcgggttttttgttctgaaatgatctgtcctctgcgccgttcatctgaatctgtaaagcatggcggaaccgatgatgcccgcgtcatttttatagtgcgcaagggcgagggcaaccttgccgcgcgagttgggcatcaggacgcggtcaagctcccggctcaaaggctccaggagggcgctgccttcgttgcagacgccgccgcccaggacaataatctgcgggccgtagcagtagacaatgttggacaggctgatggccagatagtgcaggtaccgttggattacctcctgcgcagccgcgtcggattggcgtgcggccgcaaacgccgttttggctgtgatcgcaccgtcctcgtgcgccagcagggccaggcgggaatccgggtgtgagcagacggcgcgcgccgtctgttcgatcaggcccgtcgcggaaatataccgttccatgcagccgctgcggccgcatgggcagggttcgccgtcggtttcgataacgaggtgcccgatctccggcgcgaggttgctgtaaccgacgaacacctttttttcaataataacgccagccccgacgccagtgccaagcgtaatcgtcaccgagctggcatatgccctggcggcgcccgattccgattccgcgatggcggcgcaattggcgtcgttttccacatagacgggtatctgcgggaaaaatgcggacagctcctcgccgatgcgcacgtcatgaaacccgagattggccgaatagataacagccgcgcgcgcacggtcaatgaagccgggcgtgccaaagccgatgctgttgatatcggagagcgggacggcctggctgtcgcacagcgtttgacagatgccggcgatttcacggataatttcggccgcgccgcgctccgggcatgtggaacaggccgcgcgcgcagcaatggtcccattttctgcgacaagccccaccttgatggtggtgccgccgagatccacaccgaggttgaacatactttcacatcctgttcccgccgtttgatctgccgcacagccggttgaaaataatctcattggagagggcgaacaacccgaaaataccggaatcccgcgaaagccctgaggcaacgaccggcacggggctgaacgcgtgttcctgtacaatgctgttgatgataggcagcatctggctggcaaaaacatggtattcgccgcccaaaatcaccagatcacaattgagcagtgaaatgatattgctgatggctgtgccggtcagaccggcaatttcatcaatacacgcgcggataaatggatcgcctgcctgccaggcggctgtgaccttgcggaaggacacagcgccggtttcctttgtcaccaaatgcagcgtttgcgcgggcgccttgtcgcggacacgttggagcagggcgtccaggccgatgtatttttcaagcggaacgggtccgtccgggctgtggaccaaaaagtttgcgacctcgcccgcgctttttccgctgccttcgtagagcgcgccgtcgatgataatgcccgcgccgacgcccaggccgcagctaaaataaacgagattgcgcttgcctgtgccgattccgtagttaagctcgccgaccgcagcggcgtttacgtcgtttacaataagcacaggcgtgccgaaggtttcttcaagcgcctgagacagctctggtattttccagttggtaaactgagtgttcgccctgaactcacggctttccggcagatagataccgggagaagaaatcgcgatgacggccagatctgtgttggagaggttgccggaggcggtcagggttgcaattgcatttttgacaagctccaggcgtgtcgcgaaggaggtggccggcgtgatattgatggtgaagtggttgatgcgttcaccgccaagattggccagcacaaaaattggctcctcgtagttgagatcgatcgccacgatgtatttataattcttgttaaacttgagcagaattggtttgcgtccgccggtcggcatggctctgcccgcgccgacctcctcgataatgccgatgttgagcagcgccgcaatattctccgtcatagcggatttgctgatatggacaaggcgcgaaagggcagcccgtgagatgctctccgtatgatagatgctgttgaggatgacccgctggttgatgctgcggatatgtgtctgatcgaccgtatggttcaatctggtcactccaatcgtaaggaaagaaaacaaactgcttctttgttattatcataacatgtctgccgcaaaaggcaatactggcaatttgcataataaagatacataaaatttaaattatatgtaaaatatatttgcaaaaagatatttttatattgacaatgcaaacggtcaatgataagatgcagataaagttagtttggaaacagaacgaatttataaatgcacatgcaaatacagaaaggggattgaccatgcaaaatccacttcggatcggggttatcggattggggctgatcggcgggcttcatgcgcgcattgtccatgaatgtccaaacgccgtgcttgccgcggtgacggatatcaacgagggcgcggcgcgcgccgctgcagagcgatacggctgccaatggtacgctgattttcgcagaatgtgcgacgaggccgctctggatgccgtctgcatctgcacgcccgatcaattccatctggaaaacgcgctgtacgcggccaaaaagggactgcaccttttgattgaaaagccgatcgccacgaccgagcgcgaagcgcgtgagatcacggctgcggcagctcaggccggtgtgcgcatgatggtggcgcatgtgttgcattttgatcccagatatgccaaattgcaggaagcgatcgatcagggggagatcggtgacgtcattcatatgttcttccgccgtacaaacccccgctcaaacgggcggcgtctgggcgggaaggtctccattttccatttcatcggcgtgcatgattttgaaatgatgtgttcttacatgaaatgccgcccgctgcgcgcctattgccagcgtgtcagcaaggtaaacgccgacatcggctgcgaggacacggtcatctcaaccattacatttgaaaacggcgcggtcgcaaccatcgagctttgctgggcgctgccggaaaacagcgcgctgggtatcaatacttatgccgaggttgtcggcgtaaagggcgcgggttatgtcacgatcatggatcagggcgtctcgctgatcacggaatcgaacgtctattaccccgacacgctccactggccggagtacaacggccgcatccagggtgatctcaaggaggaaatccatcactttgtgaccgcgacgctcgacggcacgccgtacattacaaataccgagcacgcgatcaccgccgtcaagatcattgaggcgtgttttaagtcaattgaaacgggcctgcccgtcgatattcaataaaagagaatcaggaggaaatgaaaatgaaagttctttacgccggcgacgcctgcaccaaaatcgggcctgtatttgtcgcgtcccctttcaaccttgaggtcaagggcgtatctcaccacatctggggacagccgctgatcgacgcgctgaccgcggacgggatcgaggtcaagcatctgacgaacgaccaggcgatcggcgaatttccgcgcacggaggaggagcttgccgaatacgacgttgtaatcatcagcgattgcgaggccgaggtcctgtccctctacccgttctgggtcgccggcacaccgctgccgcgcacggataggatgcgcgccatccgcaactatgccaaaaacggcggcggtctgatgatgatcggcggctggtcgtcgttcagcgggcgcttcggcacaggcgcatattatgacaccccggtcgaggaggctctgccggtcaactgcctcaagggcgccgacgaccgcgtcgaggtcccggcgggcgtcaaggtcaaggtgcttgacaaggcgcatccgatcatgcaggacatcccatgggaggaagcgccggtctttgaaggatttaacaagatcatcccgaaagagggcgccaacgtcattgcgacgatcggcgacgaggagatcgaatcgccgctgctcgtgacctggtcgtacggcaagggccgctccgctgcgtttgcaagcgactgctcgccgcactgggcggagtatttccagccgtgggaatattacggaaagttctgggtccaggccgtgcgctggctggccggggaagaaaaataaggacacagcagtaaagtggggtggcatgtcatggaaacagtgcgcgcgggaaagcccggcggcagggtgaagccggatttgcagcgggtgatgccggttgtgatcctggcggttttgctgctggcgctcagcctgctcaaccgcgacttcctgtccctgcaaacgcttgtaaacctgatgcagcaggtatcggcggtgggcgttgtggcgatcggggccatgtttgtaatcatcaccggcgggatcgatttcagcgccgggtacggcctggcaatgatcggtatggcggccggcgtggtttatgcacagtcgccctttcagggcagcgtcgccgccatggtggtcacattccttggcatgggcgcgctgcttggccttgtcaacggcctgctgatcgcggcgcttgatattctgccctttattgcgacgctcgcaatgatgtcgctggcgcagggcatgtcgctgatgatcggcggcggtacgatggttatgctcaccgattcgccgatcctggcggtcgggcagggaaagatcggcggtgtgctgccggtatcctttgtggtgctgctggccgtctgcctgacggcgtcggtgatcctgcaccggacaaagctcggcgtctatacatacgccctcggcggcaacgaggacgccgcgtggtacagcggtatccatgtcaaacggtataaaattctggtatacgttgtggctgggatttgtacgggcatcgcgtcgatgctgacggtttcgcgcatcgcgatggccacgccgagcatctccgggacgacgctgaccgacgccatcgccgccacctgcatcggcggcacaagcatgagcggcggccgcggcaatgtgcttggtacctgcatcggcgcggtgatcattgtactgatcagcaccgctttgacgtatctgaaaatcccggcggagatgcaggaggtctttaaaggggctgtcatcctgctcgctgtggcatttgacgcagttgtcagccgtaaaaagcagtagtggagtttacagggagaaacagattgaaaaggagacgtatcttatgaaaagagcatttgcgttgctgatggcgcttacaatggccgccggacttctggcgggctgcggctccggttccagcacaccggcggcgtcctccgcggcgccggcagcgccggcggcttcagaggctgcgccggcgtcggaaccggccggacagccggcgggcggcgcggacaagattgtctgcggcgtcgtgctgatcgatatgaccaatcagttctttgtcgatatgattgaaggcggcaacaaggcggccgaggattacggctgtgaggtgatctggaaaagcgccgacggcaatttcgacaaccagatttcgctgatcgagaactttattgagcagggcgtcgactgtatcctggtcgacccgcttgacagcgaaggcttaaagcctgtgatcgaaaaggcgtcggccgccggcatccccaccattaccatggcaggccaggtcgatgttgaaacaaactataccaccgtctacaacgacgaggaaaatactcgcatcattgcggagatgaccgccaagatgatcggcgaggagggcaagacggccctgctttacggcaacaaaggcaatctcgtctccgatctgcgccagaagggctattatgcgggtatggaaaaatatccgaatatcacagtggtggaacagcccaccaactgggaccctccgaccggaatgaaggcggcgcaggatctgatcgcggctaatccggatctcaaggcgattcactgtatttccgatgcggtcacgctcgcggcatatcaggcggttaagactgccggtaaggaaggcgagatcatcgtcaccagctatgacggtaacgacgacgccctcaaggcggtcgagtccggccagtttacgagcacagttctgaccggcgcgaaaaagaccggctattggaacatccaggtggcgctccaactggccagcggcgtgcgcccggcggaaaagatacttaatcttgatacgcactttgttatgaccgatgaaaacaaggcgaagtttgcggaaatggggattgaaggcacggaggacgtcagcgtcatcaacccggcgcaggcgcttgagcgggctgccggatacagagacgagctgtatgaccccgatcttctcgcgggctgaacgtaaagggcagggctcttatatcccttcgcggcgggcgcggcgcgcccgccgcagctttaccggcctgctgccggcgatcaatgtaggagcgtgagcggatggatacggcaaaaaaacaaaaaaaacgcggcgcggcaatgaacggggaaaccttccggtatatgaccatcgccgcgatgatcgcggtgctgtttgtgttgttctcgtttgtctcaaagggctttttgagcttcaacacagtcatgaatcttttcaggcaggcagcttccaacgcgttggccgcgatcgcaatgacaatgatcatgctgacaggcgggattgatctgtccgttggctctgtggtggcgttttcaggcgcggcgggcgctttggccatgcaggcggcgggcggctccacgctgctggcgggcatcgtgggcatcaccgtgaccgtcgcggccgcggccggctttgggctgatcaacgggtatgcggcggggtatcttaaaatcgcgccgtttattgtcactctggcgacgatgtcgctggcgcgcgggctgacattgaccgtcacgcattcctcgcgtgtcattgtcgacaacagcctttataattttgtaagccagacggatctgttcggaaaaatcccggtttccctgctgcttgtagcggccgcgtatatcgcggcgtacctgctgctgaccaggacggcctttggacgcaggacctatgcgatcggcgacaatcccgtcgcctcacgtgcgtccggtatcaatgtggaaaaacatacgctgtgcgtttatattgtcgccggcgtttttatagctctgtcgacaatcgtcattgtcggccgcgcgcgttccgcgcagccgatggcgggcgtggggatggagttcgacgttatcaccgccgttgtcatcggcggcacaagcctgatgggcggccagggcaatctgaaagggacgctgctcggcgtgctgctgacttctgtgatttttaccggcctgagcatgctggacctttcaccatttgtcaattatatggtacaaggctcgcttattctgttggcggtgctgggcaaccgcgttgtttccgccaaagcgcaaaaaagcgtcctgcgccatgcggccggacattccggcggcgcggagccgcaaacgggcaaaagggcacgcggacttgacgagattctcgcggcaaacgcgcaggatgttctggagctgcggcacatcgtcaaggtgttcccaggcgtgcgcgcgctcgacgacgtgagccttaccatcaagcgcgggaccattcatgcgctgtgcggagagaatggagcgggcaaatcgacactgatgaaaatcctctccggcgtctacacaaaggacgagggtgaaatcctgatcaacggcgtgcccgctcagatccgttcgccggcggacagcgaacggatagggatttccgtcatctatcaggagcttgccaacatcccagagctgaacgtaagccagaatgtcaacttgggcaaagaactgtcaaacggcgcgcgcatccttctggatacaaagcgcatggaacaaaagacgcgcagcctgcttgaccgtttccagctccaggtcggtgtgcggcagaaaatcgaccaattgacggtcgggcagcagcagatggtggaaatcgccaaggcgttcggttcgaacgcctggattgtggtcatggatgaaccgacgtctgcgatcaccgaggccgataaggaaaacctgtttaagatcatccgggaattgaaggaaaacaacattgcagtcgtctatatctcgcaccgcatgtctgaaatctttgagattgccgacgaaatcaccatcctgcgcgatggccgccaggtgatcgctggaccggtatcggaatttgacgaaaataaggtgatccggcacatggtcggccgcgaactgaacgatattttcacacgtgaaaagggcgcgcccggcgaggaggtgctgcgtgttgagaatctcagccgcaaaggcgcgtttgagccgatcagcttttccgtgcacgctggcgaggtgcttggcttcagcggcctgatgggcgccggacgtacagagatcatgcgctgtatctttggccttgaccggcccgacagcggtgcgatttatctgggcggcaaaaagctggagattcgctgtccgcttgacgcaatcaaggccgggatcgcgatggtttccgaggatcgccgccgcgaagggattatcccgcatatgacggtgcgcgagaatacgacgctggccgccctgccgtggattagccggtttggctggatcgacgcgaagaaggatttgtcgatcacagaggagtatattgattctctcaacgtcaagacgccgtccacagaacaattgatcatgaatttgagcggcggcaaccaacagaaggtctgccttgcaaaatggctcaaccgcagtccaaaggtcgtcattctcgacgagccgacgcgcggcatcgacgtcggcgcgaaggcggagattcatcgcctgattgaccgtctgacaaagcagggcatcgcggtcatcatgatttcgtccgagctgccggagatcatcggcgcctgcgaccggatcgtcgttctttacgagggccgcatgatgaaggagtatccatccggcagccgcgttacgcaggaacagatcatgaaaagcgccgccggccttcccgcctgattttccccatttttttcaagaagcccggcaaaaaccttccggcctttttgaaaaaaggcctcggcgaaaaactttaatcggctgcaccgcgaatagcgggaggcgttgcgcaatcaaaagttttcgtccgacttttggagaaggcagcgggagagaaaaaaggcaaggcctcttgtgggccttgccttttttcgagggcgacgccttgctccccgggccgcagccctcataaaaaacgcggccgcaggccgcaaggcaccttgttcagaagcagccatgccaaccagcagaatccataacatacgccgcagggctggcgtggattttgctccggtctttttgaaaaaagctcggcaaaaaactttagccggccgagccgcgaatggcatgcaggcgctgcgttcacacaggcgtaccgctgataaaagaaagccgccgggcaatgcccggcggctttcttctattcgtatttcagtttgcctctcctgcggcatgcgcggcctttcgctggatggaaagccccagggatgcggcatacaggcccaggcagagataaagaaccgagccggtcagcggaaggccaaaggggaaggcgcgcccggccagtgacgcaacgatcgacgggattgaaagcgtcagcgacaaaagcgcgaacggcaggccgaacgccgccagctggcgcacgcccttatcgtgtccgattccggagagaacacgcccatgcgcgagaaagaaaggcgctccaagcaccatcgacatgacggccagcatctggtccgaaacatggcggacggctgtaaaatccatgaatgtgacaagcagctgcgcaacctgccaaacaagcaaaacaagcagcagccagccgttcattccgcccgcgccggactgaccgcgcgcgcgcaggccaactgcgatcaggatgccgccggaaagcgccggcacgattcccatgaaaacaaaaacgccgagcgttgaaaacaggaaggcgagcggcgatgcgtcggagacagaggagatttccgcaattgaggcggaaatacgtccagccgcaaacaggagcagcgccgcgccggaaagtatcgaaaacaaacgcgccgcgctgccgaaacaaacacaacggatttcagaagttcttttcagcataggcaaaacgatcagcgcagcggttgatacagtcaaaagcaggttgaacaggaggacgagcgcgtcatatccctcgtaatatccggtgtcgggatcgatggatataaacttgagcgcgcagcgcagcaggacgcacagaatggcggccgccaaaaacaggcgctttgagagcttgattgtcataatgacctccaaaattggggatatatcgttgcgggaaaatctgtgtgaaacgtcccgccgaatgggccttcggcagaaatacttctaataattataccgcctggccgcgctgcggtcaagcggtatttctgctgcgaaaaacaggacggcgcctgttttgatgcgcgctgttcagactgcggcggtggcgcgtgattcaagtgggatgtaatcgcgcggatgaacaatcgacttgaacgctggccgcacaattttgccgccggttgaaagctcctccaggcgatgcgcgcaccagccggctgtacgcgcgcatgcaaacagcggcgtgtgcagctcgtcggggatgccaagcatccggtagacaagcccggaatacagatcgatgttggcgcagatcggtttgtcgccgccctgcttttcgtgaagaacgtccggcgcaagccgttcgattgcgtcgagcaggcaaaattccgcctcgaattctgtgccacgcgctaggcggagggcgttctccttgagcagacgctcacgcggatcgctctttgtatagacggcgtgccccatgccatagatcaacccggaacggtcgccggcttccctgcgcacgacacgccgcagataatcgcggatttcaccgtcgtcatcccaattacgaacgttggccttgagatattcaagctgctcgatcaccttaaagtttgcgccgccgtgacgaggacccttgagcgcgccgataccggcggagatcgctgaatacgtgtcggtgcgcgacgaggtgagcacgcgcactgcgaacgtggagttgttgccgccgccatgctcgctgtgaagcgtcaggcacaggtcgagcagatgcgcttcatcttcggtaaactgtttgtcggagcgcagcatgcgcagaatattctgcgcggtggaaaattccggattcgggttgtgcagatacatgctgcgcccatcgtaaacgcgctttttcacctgataagccgccgccataatcgacggcatccgcgcgataagctgaatagactggagcatgacattttcgatcgaggtgtcctccggcgcaggatcatatgtatacagcgcaagcaccgaccgcgcgagcatattcatgatgtttgggctggcggccttcataatcatgtcctcggtgaagttgtcaggaagcgcgcgcgcgtcagagaggatatcaaaaaagcggcggagctgcatgccgtccggaagaaagccgagcagcaaaagccaggctgtttcctcaaagcaataacggccgccggcctgcgcgcctgcaatcaggtcgcggatactgtagccgcggtaagtcaattcgccgtcgatggggaccttttcgccttcgctcaacagatagccgtgtacgttgcagatctgtgtgatccccgccagcacaccggtgccgtcggcattgcgcaggccgcgcttgaccgcaaattttgaaaacagctccggatcaaagctgttatactgcgcgtactgcccgcatagtaattgaatgtcctgttttaactgcgcatcgggcgcgctgactgttttaccgagcatggcggaaggctcctttccggcgcgtcgccggcagaggccggacgagcatttttgaatcagctatattttccatattcaattgtatcgcccagtcgccgtaaagtcaagagtatattcaagcaaaatgcaggattggaaacgtattctttcaaaaacaaagggggaagtgcaatgcggtacaatctgtttgcgggcgtcgtattcgccgcggcgatgtttttaatcccattgatggcgctgaacgggggaatacaggagcaggccggcacggccctgacatcttcagcgccgccgcaggcggcggatgtacaggagacggatgtgcagacgccggaatctgaatcatcgcaggcagcggcaaagcaggagagtctgcaaacgcctgttgcacaggttgatgacagcggatttcgcatcctggacgaacgaacggggaaggtatttgaggtgagcgcacaggattatgtgcgcggcgcgctggcggctgagatgccgccgaccttccatccggaggcgctcaaggcacaggcgatcgctgcgcatacatacgctttgaatctcaagcagtcgcgccgcgctgcagaagaaccagacccggcgctcaagggcgctgatttcacggctgatcctgccgattggaaaacatatactacaaaggacctgttttatgagcgttacggtacgcttgccgacgcatggtggaaaaccatctgcgccgcagccgacgctgcatatccgtacatcatgctgtacgatgacgagccgatcgtcgcggcataccattccatgagcagcggaacgaccgaggacgcgtcaaacgtctggctcggcggcgcgccgtatcttgtcccggtggacagcttcggcgacacgcttgcgccagattacacaacaaccgaaacgttcaccgccgatcaggtgcgccaggcgctttcggacggctgtccggacattgctctcggcgatgatccgtcgtcctggctcacagtggaggagcggtccccgagtggctatgtcacagagctttccgctggcgatcagacgatttcaggcgcggacctgcgcggaatgctcggcctgcgttcgtctgatttttccatcgcatgcgacggatcgtcgtttacctttaccgtcaatggctacggccacggcgtcggcctgtcgcagtacggcgcggactatatggccaggcagggcgcgacgttcgacgagattttgacccactattataagggcgcccagctcgccatcatcaaaggtcagtccgacgcgtgatctgattgccgcgcgaggaaggtgtcgatatccccgccgcgcagctccaccgcttcctgcgcgcgtgtcaggcggatgtacatgggcggctgctccctgcttggtccgccgactatcagagtgtattcatcatcaatgggatagcgcagcacgatcatcccggaaccgacgtcgctgcattcataccggtcaaagtcgctccaggtcagagcatcgcccttttgagaaagccgccggatattttcgagcgtaagctgcttgttctgtgcgccgcagccggcgcacagaacagccgccagcaggaggatagcggcagatcgtttcggattcatagcgggttcacccttttaatcatgggatacttctattttatatgtgcgcagagtgggcgtcaagaaaattggcggccttgcggcagatttgcaggcgctcttgacagatagtccggatgggggtatgctgaaattgatcgtatgggcgtgcgatgatggaaagaaggcgtgatggatgaaaagaaacggccggaccggttggcccataaatcttgcgctccttgtgtttccgctgctggcgcctctgtcgctggcagcccaggcggcgtttggggcgcagatgcgcaggatggacctgaacgtgccgttgtacgtctgtttttgggcagcacagttcatcgctctggcctgttttctctgggcgttctttttaaaaaaggcgcggtgccatccgcttgcggcggttggcgggctgcttgtcctgaccgtgtgcgcgctgccgccggtgttaaaagcggtatcctattcgctttattcggctttctatggacagcttcagacagcaattttgctttatgggctgatatttacgctttatatcctgttgctcattgactgctctgtgaagcgcggggcataaaacaacacaaaccggccgccgtctttatccggcggccggttttagctttcaaaccccgaaaggcgatgcgcccgatttttcaaacaggctctaggaatgggcgggggaatgtgatagaataaatgcgtggcatttattctattctttatggccggggcgatacgcgggcgcggctcgctgtcgccctgatggccgattcgatcatgccgcgctgcggacacgatcaaaaaaaaggaaaaacgagggccggccaagccggccgggaaaaggggctgctgtctgtggaattcgcaaagcgcatggaccggtttggcgttggaattttttcggtcctgctcgacatgaagaaaaaacagcttgcgcagggacgtcatgtggtcgatctaagcgtcggcacgccgaatatcccgcccgcgccgcacatcatcgacgcgctgtgcgaggcggcgcgcgacgaacataattacgtctacgcgatcagcgataccgaggccctttcggacgctgtcgccgcgtggtatgcgcgccgttacggcgtgacgctcgatccgcgctccgaggtggtttctctgctcggctcgcaggaagggcttgctcatatcgcgctggtcgccgcagacgaaggggacgttgtgcttgtgcccgatccgtgttatccggtgttcggcggcggcccgctgatcgccggtgcaaagctgtgctatatgccgcagcgccgggaaaacggatatatcatcgaccttgcggcgatcccggaggaggcggccagagccgccaaactgatggttgtttcatatccgaacaacccgacgacggccatcgcgcccgattccttttaccgcgatctgatcgcgtttgcaaagaaatacgacatcattgtactgcatgacaacgcgtacagcgagctggtgttcgacggcgaaacctgcggcagcttcctgcgctttgagggcgcgcgcgacgtgggcgtcgaattcaattcgctctccaagacctacggcctagctggcgcgcgcatcggattctgcgttggcaaccgcgaggtggtagccaagctggctgcgcttaaatcgaacatggattacggtatgtttttgccggtgcagaaggcggcgatcgcggctgtgacaggcgaccagtcgtgcgtggagacgacgcgccgcgcttaccaggaccgccgcgatatcctgtgcggcggtttaaacgcgatcggctggccgattgataagccgcgcgcgacgatgttcgtctgggcgaagctgccgccgcgctttacaaacgcgcagcagttcgccgtggagctgcttgagcgcgcgggcgtgctggtcacgccgggcagcgcgttcgggccgtccggcgaagggcatgtgcgcctcgcgcttgtgcaggacgaggcggagatgcgttatgcaatcgatgcgatcgacgcctgcggcatcctgaaatgagaacctgaattcacagccggaggatgccggacaggcgaggaattttgtacctgggaaagaaaatttttgcaggcgggctgtcggccggcaagaaaatttaacgcgcagcgcaagcaaaagacccgtctgaacggcgtttggcggctgtgaattcaggctccaaataaaaacgcgccggtcctgcgccggcgcgtttcatatactgcttgccatgctgtgcgatttgtgatagagtgaggctgaaaagcctttgaatggaacgcggcgccaagccgtgggatggagaagaaagaacatgaaaatcgtaattgtgggggacggcaaggttggctatacgctgacagagcagctctccgaggaagggcacgacattgtcgtgatcgacagcaaccggacagttctggccgccctcgcggaaaccttcgacgtgatggttgtacacggcaacggcgcgagcttacagacacagttgaccgcggatgtcggaagcagcgatctgctgatcgcggcgacaagtgcggatgaaatcaacgtgctctgctgcatcatcgcccgcaagcttggctgcgagcacacgatcgcccggatgcgaaatcccgaatatgcagagcagcttctctttttaaaggacgaattggggctgagtatgacgatcaatccggaacgagcggccgcgcgggagattttcaggctgcttcagtttccgacgtttctgcgccgcgattcctttgcaaaggggcgtgttgaaattgtcgaaatcgagctgcgcgagggcagcatcctcaacggcaagcgtatgtcggagctttacaggattgcacgcgtcaaggtgcttgtctgcgcggtggaacgcggcgagagtgtacatattccggacggacgctttaagctgcaaaagggagacaagctgtttgtgacggcttccacgcaggatttgacagctctgatcaagcatctggggctctatcagcacaagatcaaaaacgctatcttggtcggcggcagccgtattgcgtattatctgacgcgcctgctgaccgaggcgggcatccatgtaaagctcattgaaacggacccagcgcgctgcgagcagctcgcggagctgcttccgcaggctgatattctccatgccgacggttcgaatcaggcggtgctgcgcgcagagggtatcgaacgcaccgacgcggttgtaacgcttacaaacatcgacgaggaaaatttgcttatttcgatgtacgccaattatttgaaggtgcccaaggttgttaccaaaattaaccgcaccgaatacagtgaggttatccgcggcaaggggatcgactgcgttatcagccccaagctgctctgtgcaaacgacattgtgcgctatgtgcgcgccatgcagaacacgacgggcgctatgttggctctgcatcggatcgtcgatggaaaggttgaggcgatggaatttttggcggacgccgccacgcttcatctgggcgagacgctcgaaaagatccgcctcaagcccaatattctcatcgcctgcatcaaccgcggcaaccgcatcattattccgcagggaagcgatacgatcgaggagggggattccttggtcgttgtgacgacggctgaccgcatgataaccagcctgaacgcgatctttgacgagagcggcgccgtgccggcagccggcgcgcgggagggcggcgcgctatgaattacaggatcgtcttaaatctgatggggcgcatcatgatcgtggaagccctgttcatgctgccgccgctggcaatcgcggtctactgcggcgaatggctggcggtgcgcggctttctgatcgccgtcgcattgcttgcggccgtggcggcctggtggacgcgcggcggtagcccgcgcggtatggatgcgcgcgagggctttgtgaccgtcggccttgtatggctggtcgtttcgctgtttggcgcaatcccgttttacgccagcggtgcgatccccagctacatcgactgtgtgttcgaaacggtgtccggctttacaacgacaggctcgagtattctgacggacgtggaggcgctgcctcaaagcctgctttattggcgcagctttacacattgggtcggcggcatgggggtgctggtctttctgctggcggtcgcccccgcgcgccacaatggcggcgacgcgctgcatctgctgcgcgctgaaagccccggtccccaggtcgataagcttgttccgcgtatgcatcagacggccaagattctttatggcatctatgtcgtcatgacagcgattcagattgttctgttgctggccggcggtatgccgctgttcgacgctgtaaccacgtcgttcggtacggcgggtactggcggattcggcatcaaaaatgacagcctggccggctacagcccctatatccagacagtcacgacagtttttatggcgctgtttggcgtcaatttttccgtttattacctgattcttaccggcgcgttttccaaggcgctgttcaatgaggaggtgcgcgtctatttcggcattatgctggcggccatcgccgtgatcacctggaacatccttccaatgtttggcggcgacgcgggacaggcgctgcatcacgcagcgtttcaggtttcatccgtgatgacgacgaccggcttttccacaattgatttcaacctttggccggaattttcgcgcgcggtattgacggtgctgatgattttgggcgcctgtgccggttcgacgggcggcggtatcaagacggcgcgtctgattatcctgtttaaatctgccaaaaaggaaatttcgcagctttttcatccgcgttctgtcaagctggcgcgcatggacggccatgtcctgtccaatgacaccgtccatgcggtaaacgcctatatgtccgtctatatgatcgtactggcggcgtcggcgctgcttgtatcgctcgatgaattgtctctggaaacgaatttgacagctgtgctctcctgcctgaataatatcggccccgggcttgggatggtcggtcccatgagcaatttttcggtttattctgatttcagcaagatcattctgacagccgatatgctgatcggcaggctggaaatttttcctgtgctcgcgctgttcgcaccgtcaacctggcggcgctgactcgaaaatacagtccgcgccccatacgataagatagaaatttgacagggagggcaaacgatgctcaattttgattattatgctccgacaaaggttgtctttggaaaggacgcccaaatgcgctgcgccggactggtgaaggaatgcggcggcacacgcgtttttttgctctatggcggcggcagcgccgttaaaagcggcctgatcggtacgattgaacaaaacctgcgtgaaaacgggcttgtgtgtgaaacgctcggcggggtgcatcccaacccatatctttcattcgctcgccatgcggccgaaaaagccgccgctttcggcgcggattttatcctggcggtcggaggcggcagcgtcatcgacaccgccaaggccgtcgggcttgcgctggccaacccgggcgtcgatctctgggatttctggacaaaggggagaaaacccgcgggctgcacgccggtcggcgcggtgctgaccattccggcggccggcagcgaaatgagcaattcgtccgtgcttaccgatgaggaaaccggcgtcaagcgcggccttgggcttgatgtggtgcgccccagatttgcggttatgaatccggagctgacctttacccttccggtataccaggtggcgtgcggcgtggtcgatatcatgatgcatacgctcgatcggtactttaatccggtcgccggcaacgagctgaccgatgaaatcgccgaggcgctgctgcgcgtgacgatccgaaacggacgtatcgctgtgaaggatacgcacgactatcacgcgatgagcgaattgatgtgggccggcagcctgtcccacaatgacctgacagggcttggcgcgccgaaggatttcgcgccgcaccagtttggacacgagctttccgccaagtttgatgttgcgcatggcgcgagcctgtcgacgatgtggggaccgtgggcgcgctattgtatggatacaaacccggcccggttcgcgcggtatggccgcagcgtgtggggaatcagcggtgcgtccgagatcaaaacagcacaagctgcgattgaggcaactgtcgattatttccggtcgcttggaatgccgacctgctttacagagcttggcatcggcgtgcaggacgacgcggtcctgcgcgagctggccgagcggtgtactttttacggcaagcgcacaatcggaacattccgcgtgctcggcgtcgaggatatttatgccgtttacaagatggcaaactgctgatgagcagacagaaagccgtccgcctttacaggcggacggctttctgtctgccgctgtcctcaacaggtcgtaggcatatgtatacattttattgcgagtggaaaacaaaaaaggttcatgcagagatgtacagcctgcgcacaggcgcattagcgccacgcgagccggatacggtgttcagggcagcgggcggcgcacaggccgcagccggtgcaggcgtcggggtcgacggtatagaacccgtcgctgctcaatcggatgccgccccccaggcagcttgcggcgcacagaccgcagtcgatgcgcgtgcaggggttttgaaaggcacagacaagctgctgagcagggatatcctcaaagggaatcagcttttgcagggcgcggccgtgctgcgctgccagggttgtattgtgggcgtcggtccaggcgcgcagatcgctgacgattcgcgtgatgcgttcatagccggcgagcagcactgtggaagcaagctgcaccgcgttggcgccgagcatcacatattccaaaacgtgttcgtacgattcgatcccgccgatcccacagatctcgcagcgcgtcaattgtgcgagcgtggcggtcgttgcaagtgcgactggacgcaggtttgcaccggaataaccgccgcaggtgggcatcagcggcatgccgtgttctatatcgacgccggcaagccccttgaggctgtcgatggcgctgatcgcctgcgcgcccgcctgctcgaccgcatgtacgaacgcaacgttcgcgcttgcgtcataggacaacttaaccatcacaggcaggtcgaccgcctcgacaacggcgcgcacatagccgccgatttgttcctgggagcgcccgaaacgcgtgctccgtgtcccgatgggcgcgctgatgcttaactcgattgcatccgcgccgagacgttccaccttcttggcgatataggcggtttctgattcggtggccccccagaccgaacagatcaggatgctgtcgcgcttatctatgcgcttgatttcctgttcccactgttcaagatcgatggtggaatacagcatggtgttgaacaaacttccgccatgctggtagaggcgcggacagacgcgcgtgctcgcctccagcgtgattgtttccgtgacgacggcagccgcgcccgcgtcgatcgatttctggatggcggctgcgtcgcatgaccagggtccggcggccacaatcaccggattttttaacgtcatgccaagaaattgcacggataaggacatacccttccccctcctttggaaaacagaacatacacgtccaggcccaaaagaatccgaggccccaaaacagcccggaggcgcgattctgtgtgaattgcaggcggcttgcataaaacagaaaatatgtttttgacacatctaatcaaataattcatgaatatattttttgtttccacaggagcggcggattttcagcttaggctgtaaaacaacctcctgcgggacagtctcggcaatctgcgcgtcctcgatcaaatcgaacaaaagccgcgcggcgaccattcccagccgtttggagggctgctcgatgctggtcagttccggcgtgacgaggtcgcacagaagcgaatcgtcaaatcccacgacagccagccgcgcagggatatcgacgccgtcgtcacgcgcggccttcatgacgccgaaggcgagatcgtcgctgccggcaaagatggcatcgggcagcgtttccgtcgcaaacagccgccgcgcagccaaatagccgccgcgcaggccgccggccgccatgtggatatggccctgctgcacatcggcgtccagcagagcgcgccggtatccggagatgatcggatcgtttctgctgtgtcctgtttcgtcgagcagcaggtcgatgcgccgccgtcccaaaccgagcagatgctgcgtcatcttataagcaatgccctcaaagttgatatagcaggcggtcatctccccgtcgccctgcccgatcaacacaaaggcgctgctgcccaggccgcattcattcagccgcgcctgcgtcaggttggacgaggagcagatcacaccgtcgacccgccggtcaaacaccatgcgcagcagccggtcctcctcctcggggcggccatgggtgctgcataaaagcacggtgctccctttttttgtcgcgaccgattcaacgcccgcgaccaccttctgattgataccgccctcaatgtttggcacaagcagagcgatggtatttgtgcgcgcgaggttgagccggcgagcaaaccagtttggggtgtaattgtgccgggccatgacctccagaatgtgtgcgcgcgtttcaggctgcacaagctccgggtgattgagcacgcgtgaaacagtggcgacggacacctgagcctgccgggcaatttccttgatattcacgcagcctcctccttacatacaacacaaacgccgcaatcgatcgtccctatcattctgtatatagattaccaagataacatgcaaaatgcaagaggattggacatgtatcaaatataaaattgtataaaaagacaacggttaaaatttgtaatgaaagcggttacaaagaatgagccgggggaatcacacaaacggaatcgggcgttatgacggaaaaaacggcctatttttggctatttagccgctggtaaatagcggcagatcatggtatagtaaagacaatgttatgaaactattttcataacgtgtttgaggtgccggccaagaggcatggcgtgcaaatccggattgaaagggaggaacattatgagcgagcaaaccaaacggaaaccacaggcggaagacagcgaatactcgttgagcgccgtcccctctgcaaaaaagacacagggcctttgggccgcaatggtggtgcttgtcggcttcacattctttacgccgagcatgacggcgggaggaaacctcggcatcggtatgaacctgacgggctttctttcggccatgattatcggcaacgcgtttttgggcgtttactgcggcattttaggttacatcggccaaaagacaggtctgacgcttgacctgctcgcgcaccgttccttcggtgataaaggctcgttgctgccctcggcgctcatcagcttcacacagatcggctggttcggcgtgggtgttgcgatgtttgcgatcccggtgtccggcctgaccggcggcaaagtgcccgtctggctgctgattgtcatcaccggcgttatcatgaccgtcacagcttacatcggcatcaaggcgctcgctgtgctcggatccattgccgttcccctgatcgccatcctcggcgtctattccgtatcgtggggagtcggccaggtcggcggctttacaaatgtctttgcggagcatcccgaaaatccactgaccctggcggccggtatcgcgatcgttgtgggttcgtttatttcgggaggtactgccactccgaacttcacgcgcttttccaagactgcgaaaattgccgtatgggcgacggtcatcgccttctttgtaggcaattccatcatgatgattttcggcgcggtcggaggcgcggtcaccggcgtggcggatatctttgatatcctgattctccaggggctggcaatcccggcggctgttacgctcgggctgaatatctggaccacgaataacaacgcgctttacacagcgggccttggcgtgtcgaatatcgcgcgtgtgccgatgaagccgatggtacttgtcggcggcgcggtcggcacggttacggccgtctggctttacaacaactttgtcggatttttaaacctgctttccggcatgatcccgccggtcggcgcggtggtcatcctgcattatttcctgcataaggaggattactacagcgagggctacaaggcggcggcagtcaatatcggcggtattttggcggtaattggcggcgcgcttgtcggcatctttgtgacttggggcatcaagccggtcaattctcttgtcgttgccgctgtgattttcctgatctgggatatggcgacccgtaaaaagtaagaatttgtatccgcatggaagaaaggacgagtcgtatgctgattaaaaatgtatacatcgagaatgcgcaggaaacgaaggatatccgcatcagagacggcgttttcagcgagatcgcggccggcctgacgccggaagcgggcgaggaggttgtcgatgcgacggggctgctggctctgccgccgtttattgaaagccatgtccatctcgatacatgcctgaccgccggagatcctgtctggaatctgtcgggcacactgtttgaggggatcgagtgctggagcaaacgcaaacagaagctttcaaagcaggatgtgaaggaccgcgcgggccgcgccgtgcgcatgtatgcggctaacggcgtgcagcatatccgcacgcatgtcgacgtcactgatccgacgctcattgcgatggagggaatgctggagctgaaggatgaattaaaggatcttgtccatatccagatcgtcgcgtttccgcaggaaggcatccagagctacccaaacggggagcagcttgtggaaaatgccgtcaagatgggagcggattgtgtgggagcgatcccgcatttcgaatttacacgcgaatatgcggttgagtcggtcaatttctgcatgaagatcgccgaaaagtatggacgcctggtcgacgtgcactgcgatgaaatcgacgatgaacagtcaaaagggcttgaggtgctcgcgtgccgcgccttggaaagcggtatgaaagacatggtgacagccagccatacaacggcgatgcacagttataacaatgcctactgcggcaagctgttccgtttgcttggcatgagcgatatcaattttgtctgcaatccgcttgtcaacacgcatttgcagggacgctttgacacctatcccaaacgccgcggcgtcacgcgcgtcaaggagctgttggccaacggcaacaatgtttcctttgggcatgacgatatctttgacccatggtatccgctgggcgacggcaacatgcgggatgtaatccatatgggattgcatgtctgccagatgatgggctatcaggagatcatggattcgtacaaattctgtacctacaatgccgcccgcacgctgcatctgggcgataagtacggaatccgggaaggaaatccggcaagctttatcctgctcaacaacaacaatttctacaatgcgctcaatcaaaagagcgaggtgctttattcctataaccgcggccggctgattgccagcacaacgcctgcggagaaaaaagccctgttctgagattggccgacatccctcctttttcccacatggatctgcccggcgtatttgcgccgggcaggtccatacatatgccatacggttgaatcggcgcggccggcatggtatactgtaggaaacagccggatgtgcagtttacagcgcatccgggaatgatctggccaaaatgggggaagctatttgaaaaccatctggaagccaggcgcaatgctggcgcctgtgccgccggcgcttgtcacctgcggcacgctggaagcgccaaacgtttttaccgcagcttggaccggcattgtctgcacccatcccgcgatgacttatgtatctgtgcgcccgcagcgctactcgcatagtttaattgaacagaacggatcatacgtggtcaatctgaccacggcgcagcttgtgtgtgcagccgacttctgcggcgtgcggtcaggccgggatgttgataaattcgaggcgtgcgggttgaccgcgcaggcgtcgtcggctgtggaggcaccctcgcttgcccaaagcccgctgtcgatcgaatgcgccgttgagcaggtgctccggctcggctcgcatgatatgtttcttgcgcggatcatggctgtagcggttgatccgtccctgatcgatgcggatggccgcttatgcctggagcgcgccggcttggcggcttatgcgcacgggtcctattttgagcttggacggcgcatcggtacgtttggattttctgtccgcaaaaagcctgcgcacaaaaaacgccgcaaaaaatgaaggctgcacgctgggggaagggcttgacttgtccggttaaatatggtattataaacagcgtgacatatggagagatgtccgagcggtttaaggagctggtcttgaaaaccagtgaccccaaaagggccgtgggttcgaatcccactctctccgccagcagcttttcgtgtttatgatatttatattgccactgattttggagatgtacccaagttggtgaaggggctcccctgctaagggagtaggtcgggaaaccggcgcaagggttcaaatcccttcatctccgccaaaaagaatgcccactttggataccatcggcagaaatgccgatggtatcgggcttttcggggatttttggccctcaaatttcacaggaaaaacaaaagatccaaacgggggtttcacagaagatggctggattcaaaccccaaaattttttagaaatccacagcgccctttttgaaatgagatttttcaaaaagggcgctgttttcatatccagcaaaaatcagagtgccaaaggcgtcaatctctcagccaacaggctgaaggattggcgccttttttcatattccgaaaaagggcgctaaagttacagaggagggagaatcattattatgccggggacaaacgccagtggctgctggaggagattcgccgccagatcaacaagcgtggcgatccaaatccgcgggaactaatgagccaatccaatcaaaatgaagtcaacatgagtatgtaagagccggggttttagagacaagaccccggctcttttttgcgtttggaggcaattgatatgaatacagaacaaagcaaccccacatcccataccggcaaacctgtcggacgaactgctcacaagtgcgagagttgcccatatccccaccacggcttcatctgctggggcagggatggaagctgcatgcgcaccgatgtggcggagctgactgaacggcactggcggtcaaagatgggccggtaaaattggtgggtttgggtattccctttgactcgcggttgcggtattgtgtgtcgttaagaaatggaggtggaagcaatgattttcaacgcagttctcaaaaatccaaagcatgaagaatcatgaagaatatggtgaggcaaccgtccccttcccaatcccgcccaatgagtatgaatccattttggagcagatggaggcgttggagctgggggacgctgtgcggcaggactgccggatcagcgaaatggacagcgcctaccccatcctcaaacggctggagggtggcagcgtcaatctggatgagctggactatctggcaaagcggctggacagttttacagatcaggaggcggcgcagttccaggcagcggcggtaaagttcgggatcagtgggatcaaggatctcatcaacctgaccttctggtgccagcagacaacagtcatcaccggcttctccgatctggaacagattgggcggaatcactatatgaccctgcatggagggtgcgctcccaccaaggagctggagcggctggacgcccggcattttgctctggagcttatctgtaacacagatggatatgtgaccccctgcggcgtgatctatgacaatgggatacagatggaagaaccctatgacggcgtccacttcccctgctgtctgtatgatcaatcggaactggtattgggggttttccaaaaaacaggctgtaatggagtacccacatggctgtacctgcccatgccggagagacagctcgagcggcttctggaacgggactgccttaccccagagaacgccggttacaagattacaaacagcgcgctctccgccaaggtcagatacatcgctgagaagtcggagaattttctgatgtgtgataaagaagtagcagaagagtaaaaaattttgccgttcctatccgttaaatgaggtatgtcggatagggcgggcgtttattcaggaaagtccactttgccaacaaaagaatagtaaatctcaatagcggataactcggctatgcatttcccggcggcttccagttcctttttcttggcggcgttcctgcgcctgcccccgtcctcattctgctcaatcaaaagcttcataaatcgggctccatgctttgccgcatagccggtcactttccgtaaattggagagtacaccagctgtcaaaaggtcggtgtggataaagtgtgccgtacagtcatgggtgcgtttcttgtagctgccgcagatataacagtcctgcttgcgcttatccgtttggtatctctgctgatacatcacactgccgcagtccgcatagagcaatatgccggagaacaagctcacttcatcatagcgattggggcatttcgctgcttgcgaaacgcctgcacctgttcccatgtatgggtgtctaggataggctcgtagtagttcccaaagactgcctgcttatcctcgtcattgtaaatggttttgctgcacttgtaggattgtgtggtaatcttgaagtatatcagacagcccgtgtattcccggttttcaaggatatgtgcaacgatattggtcgcccacttgcactcatagccggggtggtaacagtggatgtgtaccgttctgcggtattccagcgtccccggcgtggggatttgctgctcggtcagcatacgggcaatcttggtcggatcgttcccggcaaggcagaggttgtatatctgcttgactatgggtgcggcttcctcatcaataatgaaattttcgttcttgtccatgaggtagccatatacaggcttgcttgtgatgggtttgccgttcatgccttttgagcgttttaccacccgcattttcttgctcgcatctctcaccagccattcgttaaagatattccgcagaggggcaaagtcattgtcgccctgtgcgctgtccactccgtcattgatagcgatgaagcggactccttttctgtgtgaaaatcatttccgtgtgcattcccacttgcaggtagtttcgccctaacctcgacatatcctttacgttaactgtcccggctgttccggcttcaatgtccgcaagcatggcttgaaaaccggatctttgaaagttcgcaccagaataaccgtcatccgtgtaccagcgcagattggaaaagccgttctgctttgcatagatttcaaggatacgcatctaagatgagatttgtcaagggggtctgccaacagaatttctattgttcttacttcagaaaaacaaaatttttacacaaagataaatataattataagatttttataaattgattgtatgaaatattatcattgtatatacaaaaaaggtgcggtctgccaattgcgccagagtatcaaaaggaggacatcaggcgtgaagcccaatgacacgaatagtttagcacacaggtacaatatcttgtttttttaataccataccagctcctaccacgcaataaaactgcggcaggggcgaagtactataaatgaaaaatatgttatgaagcggatggccgatttatatttacttctgtctggcggtgtccgagacaacggcgatgaggatgattatgccaagcactaccttctgccagtatgcgttgattcccatcagattgagcgcattgtttataataccaatgatcaaaacgccgaaaacggtctgaatcattccgcctttaccgccgttcatcgagtttccgcccatagccaccgccgcgatcgcattgagttcatagccgtcgcacgcctgcggctgtcctgcttgtagcttggacgcatagacgcagccggccaatgatgcgagacaggcacaaatgatgtagcaggtgtatttaattttcttgacgttaatgccgcatagtttcgagacttcttcactgctccctaccgagaagatacaccgtccgccgcacgtcctgctcagatagatataagcaaccgccatcacggcggtcagcagaagaacacaaaccggtatcatcccgccgatctttgtcatgcccaaaatcttaaagttgtcgttcataccgtggattggtttcgcatttgtgtagaggtacgcggcgccgcggcatatgttgcaggtcgcaagcgtcgcaataaaaggcggaacattgaggcggttgataaaaacgcccgtaaacaacccgcacaccgttccaaagcccagcgaaacggtcaggaataccatcaggctggccatcacgccggggtctcccagcttcaggcagatatccgccgcgaaaatgcttgccagcgccgcgaccgcgcccactgaaaggtcgatgccgcctgttaggatgacaaaggtcatgccggtggcgatcagaccgttgatagccacctgtgtagagatattcaacaggttggttgctgatgcaaatttgggaatgaaaaacaaacaagcgataaacagcgcgaccataaaaagtccgactgcatattcgctgagatagtgtttcatccgtctactcaattatatcacctctcgcagtatcctcatctagcgttgcataatacattatggtttcctcagtcatcctctccccctctacaaccgcagtgatccgcccagcatgcatgaccacaatgcgctggctgatgccgacgacctctggcagctccgaggaaaccatgacaacgcttccgccctcacggatatattcacaaatcaatttatagatttctgcttttgcatttacgtcgattcccctcgtaggctcatccagaatcagaatccgggatttttcagccagccatttagccaggactactttctgctgattgccgcctgagagataacggacaaactcctgatcgctcggcgtcttgatgcgcagcttttttaaatattccgccgagatccgcctttcctccgggaaattgataaatccgccctttgcccgatgtctcaggcttactgaagaaatattatcccgcacagaaacatccagaaacaccccctgctttcttctgtcctcaggcacaagagcgatgcccctggcaactgcgtcccggggatgcgtaaaaacgcatttttttccgtcgacataaatttcccccgaaaaataccggtcagctccaaaaatggccctcatcagttccgtcctgcccgcacccacaagccccgcgaaaccgagcacttccccctgatacagggtaaagctgacattatgaaattttgagccgcacaggttttttaccttgagaacgggaatctttttttccggaggctgggaacggatgtagtaatcgccaatatcgcgtccgaccatcatgctgaccattgttgtttcatccagacctttcacctgccgtgtacagacgagtgccccatccttaaaaattgagatatcatcccccacggcaaaaatctccttgagcttgtgggtaatatagacgatggccacattttgcttcttgagcctgtcgatcacttcgaaaagcatgtccacctcttggtcagacagggacgaagtcggttcgtccattaccaccatcttcgcgttacgggagatggcgcgcataatctctaccatctgtctgttagctgcactcaaattgcatactttttcctgcggcctgatatcctgaatatgcaggcggtccatcaggcgccgcgtgtccttgtaaagcctgtcaaagtgaacaaatgtgacaccggattttgatagtctgtcaagaaaaatattttcagcgacgcttaaatcgggaattacgcttaactcctgatgaatcacagagatacctatgtcgatgccctcttttgcattatgaggattgatctccctgccctccagatagagatgcccctcgtccttttgataaaccccggatataatcttgatcagcgtcgactttcccgctccattttccccaagcagcacatgtaccctccctggataaaaatccacggatatatcgtttaacgccagaacgcccgcaaaggctttctggatgtttttgacttgtacgagcggctccattccccagctcctttctttgttttttccaaagggggctgcccagcggcagccccctttggcctgcaaatgacaggacaggatatgttatgctgcattagggtccgcgttctccggagtgatcatctttggggtgatcatgacatccggctcgacactgccgccgccaagataagtaaggatattttcaatggtcgttgtgccgatcccggctgcatcctgcgcaacgctggctttgaacatgccgcctttggcgacgttctgttccgcttcgggatttccgtcaagcccgatcatcgggatttccacaccagcctcctcgcaggccgtaatcgcgccgagcaccgcgtcatcgccgacgccgaaaacaaaatcgatgttttccgcgccaatcgaggtcagggcatcctggaagtttttataagcggtttcacggtttccggagaaggaggcgatctgctggacattcatgtcgggagcgttctcagccatatagtcgacgaatccctgcgcacgattgcggcagctctcgacttcgtcgtaggggataatgacgcagtttcccgttttgtccgtaagaatattttccaggcagtattgcgccgccatctggccgccagcatagttgtcggtatgtacacaggacacgacttcgccgccgtccgcctggacatcgaacgtaaagaagggtatcccggcgtcattggccaactcgaccatcgtgcttgaaccgtcggtattgcagaacgcaaccgcgattgcatccacgccatcggcgataaaatcctgaacggccgacatttgtatggccgaatcgcccgcgccgtcaatgagcttgagcgtgatgcccttggcggcgcacgtctcctccatcgcagccttaatgcggttgaagtatacatgttcgagactgttgacgacaacgccgattgtgatatcttggtccgcagccgcatcaccgctctccggagcagaaaggacctcgctcgtcgcaccggctttacttgatgtgggggtcgaacttgagtctgcgctctgcccgcaggcggcaaaggccaataccaatgtgagcgcaagaagcgataccagaacctttttcattttcaatctcctttgttttaagaatttttcatttccggtcgagccggttattgacggttactccaggttggcatggtattgccaaagccccttaagatcgagtgattttcgatctgcaatcacccgtgccagtgcatccccataaagcaaaagcgattgttcgaacaagctcgtcatcggttggatggatttcagttcatccggccgaccaagcttggactgtactggtattctgacgatgtaatcggcaaggccggccgcggagctttcctgattggacccgatccaagcaactttcgctcccagcgcctttgcttttttcgcaattgcaaccggaaaaaggctctccccgctggcagaaccaacaatcagcagatcgttgggggtgatggccggttctgtgatttcccccacgtaatgagccttgagtccaaggtgtgccaaccgcttgcaaatcgattgcagggagagcagcaccctgccaaccccgacaaaaaaaacctgttcggcggcgagcagcgcctctacaagcgcctcgctctggcagtcgtcaatcctgtcgagcgccgctctgcattcagaaatggcatttttctttgcatccgtgatcgaaacgctcaaatgatacccttccttccaaccgcctgatcgactgtatttttcaggacggcaaaattttgacctacactcatcccgtttttcctgaaaaggcaggaagtccccgccacaaaagcgtcagctccccgcgcaatataatccggtatcagttccagataggtacgcccgtcgatcgtgatggtcgtggagagccccttttgatcgatcaggctcctcaaccggttgatcttgtccggcagccctttgagcatcgtttcgtttggactggaggcatatcctggattaatcatcatcagcagtacaaaatcacattgttcaagcacatattccaggctttctactgtggtcgccggcgagagtgcgacgccagcctcgattctcctctgtttcagccatgagagcttttggcagatgtggcgttcagtctcaacctggaaacagagccgctccacgccgatatcagcgagctgttcaataaaaaaagtgttgtcgaccgccatcacatgtgcatcaaaacagagatcagtttttttgcgaagctgtcgtatgatatccaatccgatgggcatactggggctgaaataaccgtccagcaaatccacatgcagcatatcgcagcctgcggtttccagctcccggaccgaccgctcgatgttgcacaggtccatgcagatagcagaaggtgctattcgtctgatcatccgcccgaacctcctattcaagatttgcatggcggcggtacatctgctcgcttgtaacgccagtcatatccattaaaatcatcacaacgtaatccagacagatcaaaagacactgttcaaacaggttggccataggctggatcgagccgggctgttgctgatcgccggttttacagaccggcgcgtcaatttttaccgtcaccgatgccatcgaaccgattatcccctccggacaaatcgtaaccacggccaattcagcgccaagcgagatcgctttttcggcaattctggccagcgatcccgtcgtcccggagccgctcgcaacaatcagcagatcccccgctccgatggacggcgtgacaacttccccaaccatatatgcctgaaagcccatatgcatcagccgcatcgcaaagcatcgtgccattagtccgctgcggccggctcccgatacaaaaatgcggttggcccttaagattgcctgcgccaacgcggtttgttccctgtaagaagtcctgttcagcgtctgctcgatttcacgggccacatcactcatctttttcagcatccgtatttccccattgcgttacaaattgcccgcgccgctccaaccgggtcgtccgcggctgtgattgcctctccaacaatgatcacatctggcttgattgaagcaaactgttcgatattttccgggctgattccgcctgccagcgcgagcttggaatttttgacgcattttcggagcttttcaaatgctcggcaggcatcgcggtccaacttttgcaggtccttgctggtatgcaggcagatatagtcgactccaaatgcatcaattcgcgcgatacgctcctccaaattctgcgtgttcagcatgtcaaccatgatttcgcgtccaagctcgtgcgcggcgtcacgcgcgttcatgatcgtgacatcgtccgccatggctaggacagtcgcaatatcggcacccgcctcgaacgcacgggacgcctcataatggccggcatccgcaatcttaaggtcagccgacacctgcttttctgggaatgcctccttcagctggcgcaccagaagaagtccgctctctacaataaacggcgttcccgcttcaataatatccacgcagtcggcaattttctccagcaggctgagcgcacttaccacactaaaattgcaatccaatgcaacttgcaatttcatcgtttagcatccccttaagttatgtattgtttctgcaattccattggcatatcccaaggatatcacttgcatatttgtttgtcaatcgcaaataaacaaatatattatatttgtttatttgcataaaattacttttaacaattggttttttctcacaaaacaaaacttattttaaaaatttttggcatttcaacgtttattttgtttttgaattgttgtttgcaaataaatatttgttatttttatattgcatttttgctatttctaagtataatgatatttagatattcgagtatctgtaagaataggcgtaaatacatttggtttctgtggcgtttattgacaagacgtaaacccaattgttatactgattttggggtttacactcccgttaagtgtgggaaggccgccgttagcagacgcttccaaagcgcggcccagaaaaagcggcactgtaaagtaaagatgaaaaaataagacccgaaaacacaaaaaagctctacactacgagcaaaagctcgcgcttacgctttttggagagttggagcccggcacactgggccggagtaaggccgttcaaggcggagtgtgggtggacgaagttgtagaaaaagatgaacatggaaatcaggttgctggtgggagagaaggatgaaaatccctgtttggtcttgcaccaggccttgaactgcttgttgaagcactccatgaggttgttggtaatgtcattgttgaagatctctatgcggatgtgctcacccccatgcagcatcttggcaggcatttgataggcgaagtagcggtcactcacaatggcgcgaggtgagcctggatcctttaccgcttccagtatggtgaaagcctgagggctatccctgtgacggtcaagatggaagccaaggacaaagcgtgtctcactgtccagaatgagccagaggtcgtatttcttgccctgtattttaacgatggtttcgtcggcgtgccactcatcaaaattgatattcaacgccggaatgagctggatggcaatgttttggaacatgggggcgaagcggatacaccagttgctgatgatcgtgtgagattcccggacatccatcacggtgcgcagaatcaaagcgatatcgtgcaatgagtttttgcccaggcagaacatgctcaaggccatgagaaccacatggacagggtagcccatccgtttgaagtttattttaccgaacagtttggacatggacggcgatgaaatagccataggcttcggcacaaaggcagagcgcctgcacctgctgtccgtgcagaaatagtgggatgtagtggtcccggttatgatgcacatacatcgctttcccgcaaacagggcaggttagaaattcttttgtccgggggcaaccggtcaattcgcagagatgattttcagcccactgataccgacatttcttacactgatacttttgacgcccatgaacattttttccgtaacgataaaagtccgttttgttgttgcacttcgggcagcagatttgatacaattttgccatgaggacgcgtctcctttctgggagtactttgtgtttgtggtaaaaccattgtaccatccgggctggcgggttctcaactttcatgtaactttacagtccagaaaaagacattaggggtgaatgcaatgaacgtcaatgatcgccgccaagcgatcctggaaattatcaataaagaggggcaagtccgagctgtagagcttgcaagccggctgaatgtgaccggagagacaatccgcaaggatctcatttatctcagcgataagaaccttttgcggaaaaatcacggtagcgcgcaggctatcagcgaattcattgaacggtctgtggacgcacgtgcgcaggaaaacgccatgttcaaacgggagattgcgcgcaccgcgctcgatcagctcaacaattgctcggtgatcttcatagattccggttccaccctgatggagatggcaaagctgctttcaaagcggccggatctagccatcatcaccaattccttttccatcatacaaacgctcatggattctgagaataccatttactttatcggcggcgaggttgccagtgtgacgcagtcaaccagcggcttctgggccgcaagcgagctgcaatccattcggatcgacattgcctttctcggaaccagcggatttcagtcacacagtggaccctgcacgaaaacatttcctgacgcgcagcttaaaaaagaggtgttgcgaaattccaaccggattgtcgtcctggcggatcatacaaaattttccaccaacgccattgttcaattcgcagagtggaaggatatcgacctgttgataaccgataacagagtaacacaggagcaaattgcaactttagaggacgcggtagatatcgtcattacccctgtgccgcaatgaacatggcatagtcgtcatctttttgaaacgaaatgaatctattgacaaaccaagccgtgccgaaaacgaaaccaattttatcagtagataaatcagaaaacgcaggcaagcctttgaggattcacgagtatttttgtgaaaagtgctgttgttttaggtgcgacgactttgtcaacaggcccaaatataaggagaagtgataccatgaaggctatttggacagccggggaagccctttgtgaaatcatgcgggaaacatgcgatgtcggtctggaagcagccggcacattccggggaccatttccttccggggcccctgccatctttgccgacaccgccgcaaagctcggttgtccaagcggcctgatcggcacggtcggggatgacgcctttggccggtgtattctcaagcggtttgagcaggacggcgtcgactgctcctgtgtgcgggtaagcggcgacctgcccacagcagtggcgtttgtctcctacacggcggccggggaccggacctttatttttcacatcggaaacgccgccgcaaaagaaatccattgtccagagacaatgccccaaaacgttggtgcatttcatgtcatgggctgcgccataatggcttcctctgtgatcgcccaaaacgtatacaaggccacccagtactattatgaacagggcgcggtcatctccttcgaccccaacatccgcttggaatcgctcagaggacaggatttgaggcagttaattgccccaatcatggctcgctgctcaatctttatgccgggactggatgagctgaccgccatcgctggcgtcgaaacggtggaagccgcagcagaaaggctctttcgcaatcctgtgcttaaggtgattgttctcaaaaacggtggaaaaggctctcggattatcacccggaaaagcaatgaattgatccctgcatgcaaggttatgacgctcgattccaccggtgccggagattcctttgacgctggatttatggttgcgtatctagaaggacattcgctgaccgagtgcgcccaggcggcttcggccacggccgcgcttaactgcgccgcattcggtccaatggaagggaatatcacccgcgctgcagttaacgaattggcccataaaaattatggtataaacattctgtgatggaatgtatcagaaaatattttgactgggaggttaacttttatggcgcagaccaatccactaaaaacaattgtaaaagaaggctgtttcgccctcacaggttccgatccgtttgttttgaaagcggtcatgaaatatgtaaaaaagcaaaatgcatattttatctgtgaagctaccgtgaaccaggtcaatcaattcggtggatatacgggcatgaagcctgcggattatgcgcagatgatccagcagctcgccagagaagtggattttccacttgaaaaggttattatgagcggcgatcatcttgggccgttcatctggcaggatctcgacgccaaaacagctatggactattcccgggaacttgtccgccaatatgtggcggctggttttcgcaagatccatctggaccccaccatgccgctggccaacgacgaccgcgcagcgtttggaaatgctgtcatcgcccagcgagcggcacagttggcaatcatatccgaagaaacatacgagtccacccgaaacgatacgccatggagctatcggcccgcgtatgtaatcggtagcgaggttccggttccgggcggtacggagacggaggaaagcgccgctgtcacaaggcccgccgatttggccgcctccatccgctgtttccaggacgcgttcacatcggccgggttggcgcatatctgcgacgatatcgtcgcagtggttgcacagatcggcatagaattttccgacgagtccgtgcacaattacaatcgggaagcagcccgggctttgtccgatgaattgaaaaaataccctgatatccgttttgagagccattcctccgactaccagccgccggagtgcctttatcatatggtttcggatggagtcggaatcctcaaggtgggtcccgagacaacctttaagctgcgcgaggggctatttgccctttcgagggttgaggatgagcttgcgcccggatttggatttgaaccttcacactttatcgatgtactcgaacagacaatgctcgctgccaagccgaattattgggagaaatattatcacggcgccccggaacagcagcgttttaagcgcaaatacagcttttccgaccgctccagatactacttcacccaacccgcggtcgttaaagccaaacagaagctcattaaaaatctccagggcgtcgagattccgctgacgatcctcagtcagtatctgcccaagcagtacgataagatccgtagcggcgagctgtccaacgatcccattgcaattctggaggacgaagttcaggccgtcgccgagcgttatttcagcgagatgcgtcgggcgcaggcagaacgtggatgaacgccgtcatgcaataaagcaactgaattgtatctgtgcattttatgtagcaaatttgaacatggcgcgtcggagcaccccggaaaaagcgtttcggctctctggctgcagtatgaaaaacatccttgaaccaatccggagcaaggatgctttttttaccgtatttcgttatggactgtaccgtctgggctgcgcttgtaaagcgcctgggatatggaactgtatcataaccgcagggtggttattttttacatctttctacttcccggtatttttgagtgcccggttctgcgttactacatcgttcaatattcgaacctccaaattctttagaaatctacagcgccctttttgaaatgggatttttcaaaaagggcgctattttcatatccagcaaaagtcagagtgccaaaggcgtcaatttctcaggcaacaggctgaagggttggcgccttttttcatattacgaaaaagggcgctaaagttacagaggaggtaaacgattgtgagcaagacggaactgaccctctccatcgaggaggaaaagctggaggtcatgaccttttggttgaaaaaggagaacgccaccgtccagaaaaagatggatgaggagctccgggagctgtatgagcaaactgttccggaggcggtgagggagtatctggaccgcaaagccgtcccagccagagatcgccccaggcggccggccaaaaacaccggcgtaccagtaatatcggtggggacggagaaaaggtcacaggaatgaggtgatcattactgaggacccaacgatttggaagcgaaattgagatggccgccctcgaccatgtggtaaaggaaaacggcctctcctacaccgaatgctgttttgagcggctcgatggaaaaacagtgaaaaaggagcaggccctacagacctgaacggacaatccccctcgtgccccgcctgtgcgcccctgtgtgccgctgtcgggcagtaccctccgcggcgacgccctgccggggctttgtgcccaagtcttgaaacgcggtaattagaggggatttcccgcccaattggggtgagccgaggggtcgaaaagagggcaggataaagcggcggcgtcaccgcccctcacaccgtcccgcaacgcgggccgggaatccgcatgaacagcggctttgcggggatagacagttcccgccttttatggcatgacaaaaatcgagttggcattaaaagtgacatggccctgccggaaaaccgcatggctgcatagtttttggaggtttcaatgtgacataaaggaggaaaatcgatatggaagaaaaaatccgctttcaaatgcggatctcaccagaaacagatcaaaaggtcaaagcggcgatcccgcttgcaaactgccagagccagaatgagtttgtggagcaggctctgctccattactgcggctgtctgcaggcggcggaggccgcctgcatcctcgcgccggaactcgccgccaccctgcgcatgacggtgcgggacagcgagacgcacacctgccgcctgctcttcaagctggcggtggaggtggatatattgatgcatgtgctggcctcggggatggagatagacccagcggtgctggataagctgcgcgtcagatgcgtccaggaggtaaagtctaccaacggcggcgtctccttcaaggatgcggtcaactaccagaatggtctgtaacagatgccccgcctcatcttcaagtgcccatacatcaagggcagcgcacaaaacgcggcgcggcgggagaactatatccgatatatctccaccagagaaggcgtcgagccggttcacccggagaatgcggacaaccccgcaacgtcaaaacagaaggatctgctctcgaacctgctgcgggatttcccggacagccgggggatgttcgagtacgaggactaccgtacggcgcccaccaggggccatgcctcggagctgatctcccggatcgttgaagaacatctgcaccagatgtccagtggggaaaagtatctggactacatcgccaaccgcacccgcgccgagaagctgggggcgcacggcctgtttaccgcgggcgcagatccaccggcgttgtcccaagtggcggaggaggtgtccaaccacaccggcaacctctggctgcccatcctctccctgcggcgggaggacgctgtccggctcggctatgacaacgccgaaagctggagacggctgctcacctcctttgcgccggagatggccaaagctatgaagattccgtttcaggatttccgttggtatgccgcctttcacaacgagagctaccacccccatgtgcatatggtctgctacagcgcaaagccctcggagggattcctcaccaaagctgggatcgcgcagatccgctcccagctagcgggtgagatattccggcaggagctgaccgccgtctatcgggaacagacccatcgtagagacgaactgggaacggctgcaagggacgcactggaagaactcatcgggcggatgcaaaccggcgcggtggaagatgggcagcttggcccgctgctggagcagctctcggaaaggctctcccacaccaccggtaaaaaacagtacggctatctcaaggccccgctcaaaaagctggtggacgagctggtggacaaactggcacaaatcccgcaggtgggaaaagcctatgcactgtggtatgagctgcgggaggaggtgctgcgcacccaccgggacaatctaccggagaggttgcccctctcaaggcagaaggagttcaaacagatcaaaaacatggtcatccaggaggcggtgcggctgggagagctgtctgctgttttccgtagtgagaaaatctcagacgaaccggaggacgacccagttccaaagggagagcagcgtctctggcggcaggccgcccgataccgcgaggctaagaaaatcctttatgatggagaaacgccgcccgaagaaaagcgggcggcattggcgaagctggagcagctctatgacggaggcttctctgtggcggcacatctgctgggaaaggcctatctggatggcgttggcgtcaaggccgatgaaaaagctgccgagcggtggttttataaggcggctgcggcaggcaacggctattccgaatacgcccttggcaagctgctggaacagcaggaacggttcaccgaagcggcggggtggcatcggaaagcggcggagcagaataaccaatacgcgcagtaccgtctcgccaagctgctgctcgatggcgaaaaagtttcaaaggacacggagaaagctgtccgtctgctcaccgctgccgcagggcaggataaccagtatgcgcaatatacgctgggcaagctgtatcttctcggaaaagagataccaaaagaccgggcggcggcggtttattggtttacccagtctgcggaacagggcagcgagtacgccaaatattttttgaagcatctggatgactggcgcaaggcagccatttcccaaggggtggggcggctgctgcaccatttgggaactctgttccggccgtcaccacccggccctgccaatatcccgcagatcactgaccgcaagctgctgcgaaagctcaaagcaaagaagcaggcgatggggttaaaatcaggcgggcagcagcaatattaatcttctcttttttgaaagccctccaattttagttcccggcgcagttcctcctcggtgggaagataggttttatacttggatgtaaaaatttgtgtattcccttccgggagagtatatcggacaaccgcgtcgttcttctcggcgcagagtacaattccaattggaggattgtccccctcgttcatcagctcccgcgtatagtagttgacgtacatctgcatctgccccagatcctgatgtgtcagcgtatccgttttcaggtcaatcagcacgaagcatttcaagatatagttataaaaaaccaggtcgataaagaagctctggccatccagcgtgaaacgcttctgccgggagacaaacgaaaagccccggcccagctccaacaaaaactgctgcagatggtcgatcagtgcctgttccagatcactttcataaacatgggtgtccggctggatctggaggaactccatcacatagggatccttgatgatcttttcatattccggcttgggctctgacgtttggatttcagccgccaccggacccttatcccggctcgctaaaatgcgctcgtagaaaagggtgtggatctggcgctccagctgccgcacactccacgcggacttggcgcactcatccaaataaaatgtccgtgctctttcgtccggcacacgcatcagaagccggtaatgggaccaactcaattcgctacacagtgtgtatcgaattgggaaagcgttataaaactggcgcatattccgtaggttttggacgctgaaccccttgccaaattcagcggtgagccgttcggagagatattccaacagtcgggcgccgtattccgcacggtcattttctccacaggcgcgctggatctgctccccgatctcccagtaggcgatcaccatactggaattgacggcggaagctattttgtgctgcgctgttacaatggagctgcggatcgattcgtaggtctgttgggactccggctccaaacggttgatatcatttcgcatgggacttcctcctgtgcgttttttcttcattgtacacggttttaaaaacggattcaatctcaatttacagcggcaaattttacatttgcgggagcagcggatagcattgcttggacaggggtgcgccatcgtggccattatgtatccccagaagaaatcaaaaatcggtgggagtacacgatcaaaaaatagcaagacacagtatgaatatcaaagtggggtgaagaaatataggcgggatcatctactatggaaaatacaccaaggaccaggtggaacgggccaaccagatcgatctagaggagctgctgcgccgaaacggagaacatcttctcccatccggcagagagaagcggttggggaacgaccacagtgtcaccgtccgcgggaaccagtggttcgaccacgctgccgaacagggcgggtacgcgctcagttttgtgcgccggcactatgggctgagtttctcagaggggatgcgcctgctgctgggcgaggatgggcagcgtcccctgcctgtcgcagaagccaaaccgaaaccggagccgaagcctttcgcgctgccagagtccgcaggaacaatgcggcgggtgtatgggtacctgctggggcagcgaaagatcgaccgtggagtcctctctgcatttgtcagagccaagctcatttatgaggacgtcccatatcacaacgccgtatttgtcgggtacgatgaacatggcgtcccccgccatgcccacaagcgcagcaccaacagcgagggaaaagccttccgcatcaatgtggagggctgcgatccggcatacagctttcattgggtgggtaaaagtgaaaagctgtatgtgttcgaggcccccatcgacctgctctcctacatctccctgcacccggagggctggcgggaacacagctatgtgtccctctgcggggtggcggaacatgcgatggttaggcaactggaagtccagccatcaatccgcgaggtgcacctctgcctggacaacgacaaagcagggcacagcgcctcagaacgattgaccgcccggctcgatgagctgggcggttattctgtccagcggttgtgtccacagctgaaggattggaacgatgacctgaaagaagaaatcaaacagcaggaaacgtttgagcgggagcaggaaggaggaatgagccttgccctttgatttttctcagatggcccccctgctctggacagtgggcggcatggtggcggtgttcgccttcatcgcggtgttttcagacaacaccggcatcaacggtatcaaatcccggcaagtaggcgacggccagcacggtacagcgcggtgggcgactaaaaaagagatggagaaagcctatctccatctccccttcctgcccgaacagtggcgcaagggcgaaaaacggcccaaagagcagggattggtggtgggctcagtggtgggcggtctgccctggaagcaaaagaccaccgccctcattgacaccggcgacgtccactgcctgatgatcggcgcctccggggtgggaaaaacagcccactacctttatccaaatctggaatatgcctgcgcgtccggcgtcagctttttggcaagtgacaccaagggggacgtctaccgtaactacggtaccgttgcgcgggagtgttacggctaccaggtatcggtgattgacctgcgcaatcccaccagaagcgatggggcgaacatgcttcacctcatctccaagtacgcggatcaatatcatgcgcaccccgatgacctccgggcaagggcaaagatggagaagtacgccaagatctgcgccaagaccatcattcaggcgggcggtgaacaaaactacggccagaacgcctatttttatgacgccgcggaggggctgctggcgtcggtcatgatgttgatcgcggagttctgcccgcccaaagaacggcatatcgtttcagtgttcaagctcttgcaggatctgcttgctcccagcaaggtcaagggcaaaaaccacctccaactgctcatggaacagctcccaccggaacacaaggcgcgatggatggcgggggcggcgctccacaccggggagcaggcaatgctttccgttctctccaccgctatgagccgtctcaacgcctttctggataccgagctggagcagcttctctgctttgacagcgccatcgacgccgagaggttctgtgggggaaaaaccgccctgttcatcgtcatgccggaggaggaccccaccgcctattttctcgtgagcctcatcatccagcagctctatcgggagctaatgacagtggcagatgaaaatggcggcaaacttccccggcgctgcatcttctactgtgacgagttcgggaccatcccaaaattggagggcgcggagatgctcttttccgcggccagatcccgcaggctgagtattgtcgccattgtgcagggcctcatccagctggacaaaaactacggcagagagggcgcgcaggtgatacgggacaactgccagctcaccatcttcggcggcttcgcccccggcagcgagacagcagaaaccctctccaaagatctgggagaacagaccgtcctctccggttcggtgagcaagggcaaggacaataattcccgcagcctgcagatgatggggcggcggttgatgaccccggacgagctgaaaagtatgcccaagggccagtttatcaccatgaaaaccgggatgcacccgatgaaaaccaaatttgctctgttcttaaggtggggtatccgctttgggaagcagtttgaactgccggaacattccgcccgcaagatacagtatgccgggcgggagaagctggcggcggctatcgcctatcgatacccaaaggcaaagcccaaacaggaaattgcgccggctgcggaattggccggggagccggttcaagagtccttggaaaagcctccccacaggcgtccgccccgcaccgactaaataagaaggagggaatctttgcgtaagctggaacaaatctatgaggacgacgcgctgtcccaccgggcaaaagccgtttacatctatctgtacggccgggcggatcgggagggaaaaagctggccctccctctcgaccatttccaaagatcttgcactctccaagtccaccgtcaagcgggctgttgccgatctcaaggcggctggatatctggaaacggagcagagatggcggcgaaacggcggcaggaccagcctgctttttaagctgctgaaatgattgatggctgaaaaaaatcacagtccacgccaagggcgaattgcgcccttgggtggactgtggtatgggccattgtgagccgtgaagtagaaccacccacctgaagatgtttatacagagaagaaacaataccgctcttttttccactctccatcagcggccgcgccttcagcgcacactgccggataccctcccgaagacctccctgatgctccgctgcatacccgctgatttcattcataaggcgagggaactccgcgtctatctggggctggatgctcctgatcatttccgcttttcttttattcacctcagcacctccccactgtcttctctgtaatcatactgatttccactgtcaaaacaccagaggcccgccgctcataaccgcatccgttgccagcaccggctcgctggcgccccggcactcaggcccacgcacccacggctgtgcccgccagaatccccagtgcaatttttctccagttaaacgtgactttccgcagcgcggcctcaaactgttttagtagttcagacttaactgttttgtaaaacacatatttacagtatcgtcaattatacactataaataatatatctgttgaaaatttataagtgattatttataaaaattgttgatttttaaaataatatgaagtaaaatataccatataaagaaataattagaaaacaataagcgcaatcattaaaacaacaacaatgtcatactcatccaataatataggtatcttttttgtgctgccgtctttggttacccggtattcctgctatctgttattcagtgtctcctgattttttgttgttagaagaaccatactggagggcaggcaaatgagaagtaaaaaatggatacagcccatttgtatcgcggtaattttacttttgacgatgggcggcatatcagtagaggcaaaagaaaaatccagggataaagaaaaagttgtcctggtggtagatctgagcggatctatggcggagattaaccgtgagtatggggtggctgacgcgttaaaattggctggatatctagctcctgcgggaacagaaattgcattaatcggtgtacattcacaagtagctgtggaatcaggatttttcgatccatctactgtggagggaatggacggatatttaaatacggtaaataccttgccatatggtggaaatacctgtcttggagcaggtttggaacgggcggtggagctgctggatggagggggccagattatactggtcgcagatatatcagaaggtgggctggttccggctgtggaacctggactaagcgaatgggcggaccggatcgatgctctcaatacaaaatgtaaggaaaatgatataaaaataaagcagcttgtattccaccagccaaagacacaaaatcgattgggacaagccatacaatctctttcagccccggatgagatcaatgaagtatcagatggaaacgaactgactgcatgtatgtatcaggttttacgttcatttggcgggagtattgaagatacgatcacagtggccagtgctgacacagatatgcaaagtgttccaattgaacttttaggggctcagattccccgtgtaaggctttttattcctcaaaatgtttctgtgcaggcgttttatgcaggtgcgggtctggaaatacaaaaggaagacacatatacagttttagatttgagacggccgtcgaggaaggggctatcgctccaaattggttcagagggaaaaactgaaattcaattgcttatggatttagacctcgaaatggaggttggcgtagattcaagactggcgggagaacttccagaaacgcagacgacaaccgttacagtcaggctttttgataatgctacagggacgcccttccctgctgctggctatagtgggcagcttaaaacgacactccttctgtcaaagccaaatggagaaacatctgaggtgtcctgtatgcttacagatgatggaaccttgaccggtttatttgaaccagatacatttggaatttatcaaataagtgtgcagatctccacaccacagttcacgcttcctgctattacagctgaaacacaggtcctggatgtacggccgccactgccagcagaacccaaacaaaggctatccgtttttatggcggctataattggcgcggtttttattataggcgcggctattatagcggtttggcaaaagcgcaggaggaatcataatccgaacatcagcttgcctgaagcgggaggcttttttggaaaagtacagatttctactgtgaaatccggaagttctgacgaaatacggccttttactgtggaattagacaggttcggaaactgccgggaaattacgctgagagaattgtatgaaagctgcggaattggatgtccattccagcaagccgggcagattcgcatattgccgggtgcggatgaaacgttgcgggttcaaaacctgtctgaagggaaaatcttttttatgggccaggagcggggctttggccaggaactgcggatctattataaccagaaattctatattgttttgaaagaaggttgcgaggaagtggaaatttatttccgtcagatggctggctctcgggcaaaagacagcgccaaagctctcgcggtcagcgtgcgttgataagagcttttgcatagacagagaaaagaaaggcggcacgatgcgacatggatttgcagcaaacaaatttcaccatgctttggggtgtggtagaacccgatctcaaagatttgcttactttggtgggcaacacgcgggatttgtctgcgcttccggatgaacagatcgacgagattatgacggcgttatgtgtcaacagttattccgagtttgagcggaagttcccgttaaaggcgtatggcttttttgatgcagagaatcaaaagatgcacttccagctgaaccgaccggaacatctgccgccggaatttgtgacggaatatccattggatagaaactctccgacaataggtgtgctgtttgacatgattgctgcgcgcagcaggcagggcgcgcggacagtggaattcgattttgaaagcctgacaaagcagctcagtccggaaaagatgcgtgcttccattcagcagatccgcaaagagatgaattacaattatggaaaatatgccgctcttccggaggaagatcctgttcgtgacgatctggcgcataagctgaacgccctgtttgccgatgcacgggaacattacaataatcctgtgcagatgctggctttggctgccgatgattgtgaacagcgtctgttgttgagcggcgcgggtgacggggatgctaagggtgcaagaattacagccggattgctcgcgctcaaagaggatggaagcctcgaggtgaaagcgttgccgcctgcaaataaaccgcgttggcagcgatggatgacgcaggcagcgcgcagctggcaaaagttttgagcgaggactatgaatcaaacgcaggggattatgcaagcttgtatgtaaaggatcttgtggtacggaccttctcgccactggcaaccacggccggcagcaaagtagattaccaacgtgaagttgaaaaccacaacgcttatctctcgctctatacccaagcgcaaaaggactttatggaatgcgtaaaaccagtatgcgagatactgctgggcgtacacctgttctttgaacagtacgaggataccgtgaaaagtaaaagcgccatgcggccgcggctgctggttgccaattgcgatcccgaaatggcggcccgtagtggaaatctcccccgtgttcagactttcttgaataccacaaatctgacaaacgatatggacaatcatatttggcaggcaattttcccgaatctcagcttttccaaagcaggggatcaaaaagaaatccggcaggtattcgtgactgcaaaacagaaaaagaaaacagatgtatattcaatggaaacactcagcacattgacagacgcccttgcggattatggaataaaaaccttcttttcatttgaaaccggggaagatacgacattcgataaggtggcaaaagaagggataggcgcgtttatagatcgttgcgctccgctgatgaacaaagattacagtgcttgcgccgtgccctgcctgccgaatgtgactgtgattccaaagaacaagtccggggttatcactggaaagctgatgacaacggacggcgaaaatgcggcatattcggaccggcaggaagatgtgcagcggttttacttaaatgggatttatattccggcggctttcattgcagcaggaatcatggctgcctgccaagatccggatttcctgcgtgagaaattcatcagaagcgtcgatccaaccctgccgggggtacggtttgacattgaatcaggagacaacgccctgctggtcccaaccacccttgcgagggaggttgcgggatggacaagatctgttaaagaggaaatcaacaggcagggttttggattcattctgtcaagcgaggtccagagtctcaaaggaaagccggtgaataacctgactgtctataaggcgcgaagtctcgcccatgacggatatcaatatgaaccgatttttcagcagacagtgtcaagctattttgagtgcgtactgcgcagggtcagttctgactttaaaaaagatgcggttgagtttttcttttctgcaaatccatccagccagatgcagcagtggatgaaccgtaaggattttataaatgcggttataaaaccggaagacgcggttacatacgatctggacgagcgggccggacattgcgagatccacttccaatttggcggcgtgcaaaagaatgttaaatggatgggcgtgcccttttcatgggcacgcccatcttttatgaaggggtgtttatttatatgaggacttactatgaaacattgggagtgtccgcagacgcaaaaacagatgagatccgcaagaactaccggcgtttagtgaaagaaaaccatccggacttgatcccggcgataaggcggccgaggaacggtttaaggaaatcgccgaggcgtgggaaacattaggcgatgaagaaaagcgtaaaaaatatgacgcggagattcaaaggtaaaaaagggggaaaagcccagttatttatattatgcgcttgccggagactgccgcctctatctgatgcgcgggggcaggctttggcaaataagcgaagggcaaacgattggcagccttgcaagacaggcataccggcagggaaaacttccacgtgaatatgcgcttcgtgtggcgaatgataaccgtacctgtaattttgtcggaaaagatggtttttcccaactggaaatctgtgaagtcccggtttccttaaagcgaggagacagaatattactagcaagtgatggagttacacaagcgttaacagaacaggagctggctgccgctatgcgaaagaggtggagctgcaacttttgcgcacattggctgatcgcaattgtggatggaaagaaggaaccggaacaagataatgcaaccgtgattgtggcaaaagctgttatagatcaggaggtatggtatgcgaaagaataacagcgcgtttgttgcacgttatctcagcaaagagggcgcctttctatataacaacgatttttatgcaagcgcggaagcagatgatttcgcctgttaccttgtaatagatgggttagaacccggcgaacgtgaggacctgtctatccggctggcggcggaagtggtgatagaatgttttgagcaaaaaccgtccattgggaaaaaagcgttgaaaaaatatgtcaggaatgcgcaggccgctatgaaaagcagccggctgcgttttgcgggcgcatctattacagtggttgtaaccaactaccaaaaagtacgctgcgcatggctgggcaacagccggttctctctgctgcggcatggcagggttgcgtatggcagcaaggatcattccctgagcgcagatctgtccacaaaagggaagctgcctaaagaccagattgctttgcatgaggaacgcaacaatttatcgcggtttttaggcgggaaatatgcccgccctcaagtcagcaggaaattgcggcttcaaaatggggacattctggctttatacacaaggggcgtatgggaaaactgtgatgaaagtgatctgctcgccagcacagcggaggcaggcaatgatccggacaaggcgcttgagaatatcgagcgtttgattcttgattcaaacccacagatattggacgcggaaagccagccggaggcaaacgggatcctcacaatgcagaaagcaacgactgatatcgaaaattatacgattgcactaatctttatcgacaaagtatatcttgatccccgaagggccaaacggatccggctgaccatcatgatattgattgttctggcagtggtattgctggttttagggatcgttttatttttgtatttcaataaacagcatgaaaaccgtgtggaaatggaatttgcatttgaaagtgcaatacagtacatagccgacaataattttgtccgtgcgcagaatgatttggatacagcgtttgatttggctggaaaattgaaagataatgaacagaaaaaccggattgatgcatatcggaaacttacagaaacgattgtcaccgcagatgggctgatggaatcgggcgaatacacagacgcgcaggaagcgtggctgcgcgcgagaagccgcagccggcagaccgattttgcagcccaaaaatatattgagcgggggctggaacaggcggcgggctatctgagcgttcaggattatatttcgctaggcgatatgctggcggaccgcgggaactacgctgcggcagaggaaaagtatctggaagcgcggcggctcgcagcaggactttattatgaagcgggaaaacagtctgcatttgaagcactggactccttatacggcaaaatgcagggggaaaccgaggctgtaaaggaacaggcggcagcagaatctgtagcggcagattacattgtgcagggtgataaagcgataaaagaaggggatcttactgcggcgaaactcctatatactttagcgagggagcagtatgcagcgttggggaatgagattgtgcttgcgtcgattgatgaaaagctggcggcattaacccaaaaagaaggtgaaaaccagcagcagaccgaaacggcagagcagtatatgtctgagggggacgcccttctggacaagcttgaatatgccgacgcaaggcaaaggtatatccttgccagggggatttacgctgatcttggggatgaggatggtgtgaatgaggcacgggaccggatagatacagtggacggctatatcagcccaaaaaagaattagcgtttcagaatgggagttttgaaaatgaacagacctttgcagaatcagccggatgaaacaaaaatcttgatccgctaccggcaggaagaacttgaacggatgacgctgcttcagcttagagatatttgcgagcggcaaaaaattctgcatggaggtctgtatcagctggacaaagaccggcttatccgattaattctgcggtttcgcggcagttatggaccattgctgattcagcagcctgcggatggcggtggggaacgcattgaacaggcattgcggggtgtgaagttgcatttgctgcccgacgctcttgaaatcccggcaaaaattgtggtatgggaggggcttgatacaggttattttgacgggtacaccctgccaatgcggcaggaaatcgaaggggtaaacgcagttgtgctggaccgggagggcggcgtctgtgcaatcttcaacataattgccgcacaggagcgggaaaaactctatttggcccggaacggacagctcccatgtcggcaggcagaggcgcgggattatatgctgctggtctttccaaggcagctttcagatcgcatttttgcactgtacggtggtcaggatatatccctgccgcctgaaattgaggtgtatggcgtgcggctgctggattttgtggtgcgcaaacctgtacaggccccaatgcctttgtgtattgactttggaacgacgaataccgcggcgggtatccacgcagatccgttgttctgcgaacagttcggcccggaacttgggcaggttggtttaacacaaaataaaatccactatgtccaatggctggatgaggaggggagtaaagccccggttttgccgacgatcatcgggattgacaggatcgaggatggcaagccggtctggctgataggccgcgaggcggaaaaactggttatggacggctttttcggggaaggggtttcggtctggtacgatatcaagcggtggctgggagactgtgaacagagtgaagaattatccgaccatcgaggcaaccggattatggcaacgcgccgggaaattatcagagcgtttttgacctatgtgatcaaaagcgcggaacaacggtttaaatgccattttcaaaagctgtatctctcttgcccggttaaacaaaaagcgcgtttcctggcattttaccgtgagatattccctgaatatgatttgcttgaacaggatatggtggacgaaggcgtggcggtgctttataacaccatccacagctatattgaaaataattattatgaaaatgggatatggtacaaagccttgattgtcgactgcggcggcggaaccacagaccttacttcagcagatttttcaataacgaacagccggatttcttataaaatatcgattaaaacctcttatgaaaatggagatacggattttggcggcaataaccttaccttccggattttacagatgttaaaaatagaagcggccaggcggctgacgggggaaggacaaagcctttatgagattacggcgggtatggagcaggaatgttaccgtacagtggatgagcagggaccggcgccgctttatcaggcgcttaatcaggcgtatgaacaggccgaacaggtgatcccaacccgctggcaggagtatgaaaatgcaagccgggacgaatatcatctggtcagggggaactattattatctgtttactttggccgagcgcatcaaaaaggctttcttttctgacagccgccttcaggcggtaacgatttgttccaatcaggcggccgcatcagaaaatacggaaaatctgtggctggcggcttcgcggtggaagctgtcggcatttatgaatgggaaactggaattgcaaaaggaattcccgactgtgcatttaggggcgccgacagtgcgcgtagttttgaacccggatatctatgacctgatccgccgttttttcggaaacttaaaattggaggagtattccgcaatcaatctgacaggtcaaagctgccggatcccattattccgtgatgcgctcaaggagttcatcccaggccggtatatccgtacaggcggtaaggcgcaggaggattaccgattgaaactgagttgtttggatggggccatccggtatattaccgaccatcagctcggcttgagcagcgtaaccattaaaaccggcgatatgtcgctgccatgggaactgttcgcttacatccatacgaaccagaaggctgtgctgatcccccgccttagcagaaattcgggtattggcacagtatcccggccaatgcaaagcagccgtttgcagctgtatctggaggatgtgcatggcgcagtaaagcatattttttcggtagcctgcccacaggaacaattccaatctgttacctatgaagaacttgcgggaatatatggggacatcatcccgcaagctgagatagatattattgaaaatggagaaatccgctattttgtttgggcggatgcggctcaatggggctttcatgttcttccggctgcacgcagggaggaaacgctgctcctggggcatccacagcttttccccttcgagaacgatagctggacagtaaactttttcgacgggaaaaaatgatgtgaggggggtctgcattgtcctttatcagtaagataccaacctttgcgcctggtccccttcgcaaagaaatcctgtttgcgctgcgcgatttgacttgtgtggaacaggaattgcgttatggggaatacagtgatggaattctgtcgggatgccgtctgtacgaatcagggatgaggatcggcgtggaaaaagggatggtcaaatatacggggcgcgtctatatgctgcgggagaaaaccagcgtaccgtaccgtccgaccgatcagtggatgatgttgaaaatccgttttgccccgcagattgctatgaaagagtatatctttcatacaggggaacttgtgttggaggaaaacgtgcagcttatgccaaacgagttggaattgggaagattcaagttgaaaaaaggatcttcgttaagaaccgaatataaggatttcgccgacttgcagactgagtacgatacagtaaatctgacgtttgtgcgtcaggcggggattgggaaagcaacattacgcccggaagtgacgcaccggtttgcacatgaggcttatcctctggcacaggacccgcttgatatagcgttttgcgcaaccgcgcttgaagcagccccggtcccaaaggattatttgcagcattatatctgccggcggctggggacgccttacagggaaatggctcatgaagaactgctgccggggcttgcacaagtattacaaatgctgtatgggtgtacgcaccgtccgatggataaattgtcggggatccggctctttaactaaaaaaggggatagaaatgcagacggaaagccaattaaaaccgattgaaacctgtccgaaggggcaccgttataacacgataaaatatggggatacttgtccggtttgcggctcgaagattgccaatgctcccaaaacggaagatgagtggaaaaaagagatagaactgccgcctgaacagtgggcctgtgggatgttggtttgtatcaaggggcttaataaagggcgcggctatctgatccatgagggcaaaaattatattggcagcgacccaaacagtgatatttgtattcgcggagatgataagatacagccccgcaggcatctggtgatcttgtatgagccaagaagccggaaaaccatgctgctgccggcagaatcccgggggatgatctatatggaaagacaggcggtttatgaacgcagggatttgcagcatcaggatcagtttgtaattggtacgagtacattgctgtttttggaaatctgttcagaaaatttcggatgggatgatttgcaggcaggtgattgaatatggatatgcggcgctatctatcggaaaaactctccttaatcccggaattgggcgaacgggaaataatgcggaaaacaatggagcaggtatttttaccgctttatgaccacatgatggaaaaatatgatgggcttgaacggcgaatttatgaagaaatgcccttcctgccagggctatatacaatctgcgctacattgctcccatataaaaacgctggagattatccgtggctggttccgatggacgggtcagatttggaacagggacagaaaagctggggaactgctatggaaatgctgaaagaaaagcatatggctattcttgatacggttttcctgaaggacgattatcttgtttgccggcagatagaaaaatcggatcaaagatatcctgcctgtttaaaaataggagaacagaagatcgccgttcgggttaaattaaaacccgcggttcgttatcgggaaaggattcggacactttaccgccactttcaatcaaatgggatcccgtgggtaacgcccaatatcccctattgctacaaaatgtttgacgtcgttttgtcggaaaatgaaatcaaaggggattactggccggaagcaccgctggaaatccgcttcgaatttgatggtaaggaggataagtttcaaacaggctttctccctgtctggaatgtacatacaatcagggccggacaatcagcgtttcccgcgccgacgcctgatcgtatcaattatgaataccgatttcaattccctgatttcgatgaaagcgggtatctcgtcgatttggataacccggaattgatctccatgcgccgggaaaaggatgcgctgattgcggtttctcccaaaaaaggagggctctcatgggatatcctgcaaattttacagcatataccttccgagacagagcagttccctttccctcttacatctaaccggcaggaggatggctttttagggcggttgctgctttgccatggggcacagatcaaaacacgcgccgagcttgcccgacgaatacactcctttgatgctgcaaaagaggtgcgttttgactcatttcaattaagcagccagcttattgcaggggagagctacagcataaatgacttcattgaggatgaaatccatgacagccaatctctgaaaaccatgattttaaaattccgatccgctggattccccaattatttaacaagggactatatgagtatgcttgtttctcaggtgcagcttgctttcccggaatttcactgtgcaggggtgctcttatgaattatgtatgggaggcgctgttgctggctgaagaatcgggcgttaaggaggagcaggttgtttttgtacaggcttcggcaataaacccatatttagaaactgcgtttgaagatcttaacttgaaggggcttgaaaacgcatgtgttcctgtaaatcctttgtatcggtttgggcctgttttcagcgcgttgataggtgagcaattcgaccggttctcagcatccagaggctttctgatcgatgtattatttcattttctggcacagatggatttgatggatgggatgtccagattggaatatcatcgaaagtttatgcaaaaagaggttgtgaatggccgatatggcaaaggaacaggagaaatcttttttacctttccacatgcgcagcgcctgcatattgtggatcacctgcttgaactatataaaaatggggcatcaattgctttacttacctcgttgctgcaaattctttatcgaaattccattatctacctggacaccacatacaaaagggaattgctgatctatattggcaaggaaaagacgcggcagttggaaaaacagattggttttcttatggatttatttgtgccgttggatatctctgtgcagttgttttgggatatgcatttcgggattatctcggtagaggaaacaatggaaccggatgacattatgatttattaggatggagggatactatgccatacggagatgaagaaaatattacagcacgacgggcggcacagcttagaagcaaactggatatttcaaaggaagtcgaaataggtgagcatatttattcatttaaaacacgtctctttccggacttaaagttttccatggcagcgccggaacaaatggaggaacttacaggggatgcccttattttaaaatatccatctcaattccgtccgcaaatgattttaaccactctggatggcgctttaaatttgacattagatcggctggaaagtgagcggatagaatcagaaagcattttggaaatggttcaaaatctgcgtatggctgcaaaacggatgaatccttcagccatctacacaccggttgactggatagacgcggatattccagttgcctgttttgagagctgggtgggtttatttgatggtgagatatggcaaataacctttggcgcatcaatcaaaggggtgcttttaatgggcggcttctgcgctccgaaagaacagtcgcagtcatggtcggttctggcaagacagatgatagaaacgcttcatatactgccggattaagaatagggaggattatttatggacgggatttcgcaaaggctgatgctggcgctgcaaggcatgaccccgatgtttgtgggaaaggattttcacagccagtcgaagtctctggcaaaggatctcacaacgatgatgatacagatggcccggactgagtttcctgccagcagcggcgcgcagacgcaggcgccgcccacgcaggctgaaacagaagtgatagatgaggttgtccatatcctgccgttttacagcgactattatgattatgatgatctgggacttaaaacaggtatgagcgattcagtttctattgtccatgatatgataaagacagcaagaaggctggaagggcttgaggatattgacgcaaagtaccgcggtgaagaatcgctttatacctatcagtccgatgaatccgttccggcttgggaaatgtatctgccctttgtatataaggatttgcctactagaaggacagttgagattgaaacaagcgtaacgggagaaaaaacagttgaaaagcgtcccgaacaagatcagttggaagaaaaattaaagcggcatcgggaacaggtggagagcgcctgcaagctggcctgcatgatttattatggcggctctgcagagactacgccgcaaaccgcttatgaaacaatgttcgatgatacgacgagaatatccagctacgggatgtgggggaaatggtatgaaaaaaggaacggatggcatcgggggattgatatgtgcttagggccagggcgaaatatttatgcaatctgtgacggctatccaattcagaaaaaaagctattattttaatgtttttataccggaatttaatatcacggtaacttatatgcatcttcaggtcaatactgcgacggtaaatttaattgatgcgacaaggcgaacgattaatccaaattatatggagaaaaatgctccaaaaacagaaattgaaaaatttatagattgttacgaagaaatttgtgagggtattgaacagggttctattccgacaggcgcagaagcaaaatttcaagaattacaggataatcggatggaagcgttgcgggagcaaatgtgtcagggaattcccaaaacgccatcacagttggaaaaaatattaggagatctggaagcgatccaaacgcaaacagaacgccttgagcagattaaaacaaggatgcaggaaattcaaagacttatcaattcaggcagaatatcgcccgggctgcaaaaggaactgaacaatttatctgcggagcaagcttctttgtatggggaacaaatggcggcgtctatggtttacttaggcgtccccaagctgcagagagggcagttggttggaacagagtctgatataggagctgatggtgttatgcatacccatgtggaaatcaataaaggcttttttacaaccaatattttgcggccgtgggcggatattaattatatgggatataaaacacctggatatgctgagttgtcaaatatcacgcaacccaaaatcagcgatattatagaagcaaatcctgaattagagggattttccatgaatccgtacccctatatagacgcatggtttgaagcatatggggaggaacgagcatgaaaaaaatgattctgttgttattgcttttgtggctgtttacaggctgcgcatcaactgagcagacggtttcagaagcagaaagctcagatagtgaacagctattatcctcctgcgaaagtgagagctccgtacaggaattggaaacagaagaaaacccgacgccatggcttgctgaggaaccgatcagatgcgggaatgaacagatacagctttcttttgatgagttattccaaacaagaggatttttggtcggagaatactgggtgtctctacgatggaatagtgtagagggaacaggctatctgcgtgatgtaagcttcaaactatccccatcagattattttccaaggagttgtaaaaacggtggcgcaatattgggaaaggattcatgggatgaagactatctggttggattcaaggaattggataatcacgaggaacatttggcggcacatgacgaaaagcgaccggtacattatgcggaattggaatgctttatctttcaagatggggaatttcgttcgtatcctgtagaaagctggcatcagtccgatagttcccgcgatccaccgttggagatttcttatgaccccgatactcgaacagcggaagtatcttctattttaatgacagcaaaggtgcagatggataccggagaaatggctacaaagttttcaaccgaacggctcaaaaaagcgaacgaagaagcgaagtatgtgctatacgccctgaatgaagcggtggtgtccacattagatggaaagtatgagataggggtgatcaatgatgacataaatagtcatgtatatttttctaaaaatacccaaacaggagaggaaacatatatcgcatacggcagcataccaggatcgagtatcgcaattagcaatgttattgagaagcgcgaaggatatgtgtatcgggagatgacggaaaaagaacgcagagcaaggatggggccagatataactgagattatgaggcttgacggatatacgctttatttcccctattggaatatcgcatataacattgaaactggagaacaggtggaataacgagatgaaagaggatgcaagatgaaaaagcataagctcgcatggctgctggcaggggcgcttttgctgaccgcctgcaagggggcggagccggatccgggtacaagcgcatccagcgcagagccggcatattccgcccctgaaagctccatcccggccgggccggaagaaaatcagccggaacaggctttgaaaaaaggctattattgggtagatcccgaaggaggaaaggaaccggaagcagcagaaggaatatacagtttcgaactttatggacccctctggggagggccttatggaaccttctggacaaatactgtaggggaggataaagaatatcggtataatgcatatttcagcaacactgacgtaacaatcaaatcaaaggactttgaagaggatggattggattgttttttcccatttcatgttttttcctatctggacgaagaccgcgtcatctgtatctatccgatagattccagatacattggagaaagtgatatctttgatgtcaatgtatggcttgtaaaaagcgacggtacgatgcagcagacacacctgatatacgacctgtatcaagctctgaaaaaagaggatgaaacgcttgcgctggacaaatttcatggttttttggaaggtgttgtatttgaccgggagagcggcctgcattatgcattgataaggaagtctctcccagaggacgattcccagtatgtccggtattttgcaatttttgataaagaattcaactttttggaataccagccggtggatggcgcgttgcaagagtttggggcagaagccttttaccttgactggcaggacgcatatgaggaagcaaaactttcaataaactatattggttcgcataaggtccttgtgacccgtcagttttttaccggaaacagtcctattacatatgcaatttataatcttgaaacaaaagaactggttatggttaaaccttttgtagaagaaatatatagatatacttcaagattgtcttcaacaccatggggatatgtttatatatttgcttctgtttatccaacaaaagaagcatgggattcaatgattaaaatggttgaagtaaacagtggagaaatcaatgtgatcacgccttttccaaaggaagaaggaggaaagctggaaacgccgtttggagaaattacaataaagaagtttactaattgtttggctgctccagaccagagttttctgcttttcgtggaatgcgaagaatatgcgtggcagccgcctgaggcaaacagggggatatggccggaagggacctacacacaagctattgtaaaatacaatatggacggaacaaaggaatttgtagcgcccgcgagcaaacaggcgctattgagaggtgtggatcaggcggggcggctgctgatctattgggacggcgaaaacaacggataggaggcggtggttgatggcgtggatgacaagacaggacatcaccataggaggatatcagctgatggagctgtcccagttccagatacaggctgaggtaaaccagcacggaaagctgtatctggaagggatgctcagtgaagataccgtgcgccggctggaaacaacggatcaatccgggcaaacgattcaaataattgccgccggtaaggtgatctttaccggccagccggagcggatagaaatacgtacatttaacggctgccacaccatgaaattggaagccgccggtttcagcaatcagctttcgctggttccgcatagttacttttaccaggataccgcgcaaagctatgaagatatgctcaggaaagcggtagaacattgcggcgggagcctgatcgctgtgcagggacaggagcggataccggcgccggttctgcaatactgtcagagcgcatgggattttggcctgcgcacagcttctatgctgcatactgtaattgtaccgaatcttgcagccgattatccccagatttgccttggcctgccggaaggaacccgttatgaagtgaatccgtccgccttggaaaagcgcgtcgctttttcccggcaaagatatgatgaggctgctcaaacagggcaaaaccacacccggcaggaatatatatcttacatctgtgaggacgagcgtattttttgtttaggggaccgcataaccgcagatggcgatgaatgggcggttatgtcattgtcccattcttttaaagacggcgtgctgattaaccaatacatattgggagcgcaggcaggttttgcgcttccctacaggggcaatccggtgcagaccggcctgatgctggaagggacggtcaaggctgttgaaggagaatctgtacaagtttgtttacagatcccggacgatgcgcaggaagggaaagcctcgtggtttgaatatgcgcccgctgccaataacgggatgtatgccatgccgcctgccgggacagtggtatcgcttgaatggatgggacaaaaggatggggaatgcaaggcagtccgcaccgtgcgcggcggtgaaaaactgccggattatgcagaaaggtcaatgattaccgagtatggtaaacagatgaacatggggccgtcggcgctttcatttttgtccgactccaattggatcgggctggaggatggaatcaagctgaacacagccggccggctgaaactgtcagccggccggaatatcagcattcattccaggaaaagcgtttctctcaggatgccgcagcaactgttcatgtccataaaagggatcccctcaagtatttggatggagggcgggcggatacacataaaatcggcccaaagcagcctgaaaagtaacaacagtaaggcaatgactgccatgccatatcgcgaaattattaatccagtggcgcttcaagccgggacggtattggcgcttgccggaatgacgccggcaacggctggcggcaaataaattcgcggatgtggaagatgaagggatgtgaaaaaggcagatgaaatatttcaggattcgtcaggaggacagggatggacaaaattgcctgataagaggattgataacgcttccctgcgctgaagatctgcggcgcggagaaatccggggccttccgctttcgagcagccactatatcacatcctcttttgatgtccttccggaaattctctgcaaacagatttttatggtatcgcagggcttatttgatttggtgaccttatatcttggagaaacggaataccggaacttttttcttgaggatgatcaggggcggcaggctttttattatatcccacagctccctttgatggactgcttatctgaacagagccggtcaaaccctgataaaagccggatagaaagaacaattatcaaagcagggcgggattacccggacatctttcagatctccgggatacgggaccgggcctatatcctgtccctgccgttcgcggaaagcctgctgcgcagaggagccgggggattctttctggaggaagcggcagttgaggaaaaaccggatacggagaaaaatctgcatatgggagggcgggagctatgacaatcaatcaaatcaaaatcaatggattcctattcatcgatttgctggagatggaattggagcaacaagtgaatatgcatccaacagcagttgttaaagggcacattgcgcagccggaagcgtccttgtttttgcagcaggcgaccgctgaaaaacttctggtgatcacggcaaatgactctgaaggtacggggcatacgttgttcagcggtgttttaagcggcctgtcctgtataactgcgaacgacgcttccactgttgtgcttcaggggatcgggcacagttccctctgcgacgtccgcagggagatccgcgtatttcaagatgggggcatgacctatgaacaggtctgccaatctcttaccagtcagccgggcgccagctttattgtaccggaaaatggggcggatgctaccggcggcatgctggtgcagtatgaagaaacggattgggaattcgccagacgcatagccggtagattgggaacagtcttaatagcggacgcccggctggactttcccaacatttcaattgggatcccgagtggaggaaaggtttaccaggaggaccctctggaatatacaatggtgatggatgtggcggcctatcgcgatttgaaagaaaatggcgtgagggctgtggaggatggacaaagagggatttgctataaaagccgccaattttacagtctgtgcgatcaggttgttgtggatggtgtcggcaggctggtatatcgccggaaaatttctttagagggcagcgaactgattgcagcctatgagctgcgaacccgtgaaggattccaaacacgggaacagcacaatatgcatctgataggcgcatccctggcaggaagcgttgaaaaagtggaaaaggatcaggtccaggtgagtctggcgtatgatgtggaaggcggtggaaagcggtggttcgcctattccactccttacagttccccggatgggacaggatggtattttatgccggaaccgggcgatgaaatccgcctgcatttcccaacccaggaggaagacgcggcttatgtagtcagttccacccatatcacacatgggaaccgcagcgatccggaggtgaagttcatccgcacccagcgcgggcaggagatcacattcgcgcctgattcgatccatattacagatgggaatggctccagtatccgtatggataagaaacaggggatcaccctgaaaaccagtaagggaattaaaattgatgctgcggatgatatttctataaaaggaaaaagcggggttgtggtagaaggcggcaagagtgtacagatccggcagaatgacagcctggttcaggtgcaggaaaccattgatatcacagcggcccatgtgcgggtacagtgagatggaaacagggctgttggaaaaaagcatagcggatttagctgccggtttcgaaaatgcttttgaagctgcatgggcaaggtatgcaattttgcagggagcagaaaagaaggggacgttaaacacgatttggatttcctatttgcgtaccggcgttttaatggatacggcatggcttcaaattgaccttctggataaaggcggatggggagctttggaagaatgctgtacggattgggatataaggccggctgttgcttctatatatgaatcagcccagagaaaatatgggcaaacagaagcggaaagagaaaagcagcttttggagaaagcggaacagtttatcggaatgttgaaaaaacacctccccacaatcattcagactgtgcgggaggaatatccgcaggtccagttccggtttggagaatatatgggaaccagtcaaacgatataggaggcggcgatatggaaatcatctatccagtcagcggggcgaaacttgtttgcgataagggaacaaggtatgcgcatttttacgccggatcacgcttttcaacaatgggaacagggagggtaggcattgaaaccgactcttcccctgaaaatgtagccgggaatttcttcaaatgcaccgtaacaggcgcagagtgtgataaatgcttttcgggggattggcaaaatgtctccagagaaatcacgcagcaggatagggacggttctccgcgcggcttgctcacaatgcgttccagcctgcattgcgcccggatggggaccatcacctttttgaccgatgggcaggaaatgattgacaatataaagatgcaggaattgcagatggggaatctgcgtgaacgggtcaggcggacaatctacgcccattatggctttacagcaccgacagaggaagatattgaggcggcaagacaaaacgccgcagcagcggcagacaccagcgggatgacagaggaagaagccgcaaaggcgcgcgaggaagcgggcgatgcggcggcggaaaacatgaagtcaatggatgataagctgtatgaggaattacgggagctgggcgccacgcaggaactgattgacgcgattaaaaagaccggaaaaaaggtttgcgaaggcggcgatcagggctacaaagacgaaagggaggctttcgaaagactaagaaaaagtaatacaaagttaatggaacaagtaccttttgtacatcgtgctgggtaccaaacgcttttgaattcattaaaagaccgtcaggaggccctgatcagcgaacgggactacgaaaaagcaaaggcggatatagcagcggagctggccggcatggacgaggcccaatcgcttaaaatcaagcggagaatcgaaaccaggcagcttgcggataaagtgatcgagctgttcaaagtcaatgaggacaacccagctaaagagcaggacccctgtaccctgctggcgtggctggtactgctcagggagaattacgagggagaggtaacgacactggagtctctggaggaagctgtagctgccggggattacgaggcttacggcctcatgccttcacacagaggattctttcgcgaggaagcttttgagggctatttgaaccgtgtaaaacagatcgcacataccatagaacattgtcaccctatcccgggttttaatataactacagggataggaggatatgctgggcatgttggcgttgatttcgcaacaggagtgattggctatgaaattattgccacaacatctggaatggtagaaagcactgcgataacgcagggcggatatggaaaatctgtaaaaattaaagactatgctgaaaatatacacatatacgcacatatgagtgacaatagtatcgtatctgtcggtgattatttgttagcaggaaggttaataggatatagcggaaatactgggaatagcacgggtccacatttgcattatgaagtacagagcaaggggagctatggagacaataaacaaatatataacgagcaattggggactccaggttatcttaatccagaagatttcatgccgtaattaaaaacatggaggtgcctgtgaaaaagatcatttttcttatgataaccgtagttttattagttgcttgcacaaaatccatagacaacattcaaccagatgatcctggatctcaagatcttagcaatacatcggactttcgttaccagccggaaatgaattcaacagaaaacagcatcataccgaaaccaaccgctgaaatttttcaagaaaatggcttatggggggtacgaaagtcaaaggatgtgttgattcccccagtctatgatatgatccaacctaatccatataatgaaaattactttttagttgcactgttagatcagaaccctgccggtgggaaaaaagaatttccgcaggcgaaatggggctgtgctgatatcaatggcgagatcgtaatccctgtcgaatatttccgcctttatccgggtagtcaaagcattgcggcagaaaagagaacggagacttacaaaaaggaaggcgtgggattgctggactataataataagatactggttccctttgagtatgatatgatttcgggattttcaaatgggagatacattatatcaaaacagaatcgatatggagtcatggatgaaactggaaaagaaatgatcgctcctatgtatgataggattctggagttcggaaaaaatggctatgcaatagcatttaaccattataagggaatttgcaaaaatgcaaaatctgattttcagccctccattccggacttctatcttttccaatactctgtgataaaccgggatggggaggcggtctatcaatgcccgtatattttcaaatcaaaagatgcctcttttgcagaaaagttagaattgaaaaaggacggttatcctgtcatccatatagatgaatccagatgtcaaaaggaagttattgaaataaatggagcgtatgggacatggggaagtgtaaactttaaaacctatcaaaatggttatgatacgttttattggggcgaatatgcgggctttcagcccattgagagcattctctgggatgaagcgatgccgattatttatggagaatacccatcatgaaactgaaatggcgatatatttgtttggcgggaatgctgctgcttaatgcttgtgggcaaaaagcgcctttcggcacgcaccaaagtttggatgcggcacaatctgtatcgactggtgaaaatgaatcgctttggtttagtacagcaggacatctgaaaaatcaaatagaaaatgattcccttagttctaatgaagaaaaacaagaatttgtcaaaatagaagacgataaagatatttcgagtccggaagaatctgcaggttatacgaataatccgcaagatggcgaaggtaacagtaatgaaaaaaccgcagaaaagtctgaaaccatatgggatcaatatgatattgtttacccggctccagttgagggctatgtaattgtccaacgagggctggtacacgaagttaagcaggggctattaaaagaaaatggggagatcgtacttccggtggaatatgattttatctcatcagatttatccgaagggctgctgacagtccaaaaaaacacgaagtttggcgcagtgaatttaaccggagagactgtaataccgattgaatatgaatatctttctaagttttcagaaggacttgcggcttttaagcagaatggattgtggggatatctcaacaaaaaaatgaaaccgtaattaatccagtttatcaagcggcaggtaactttgttgacggcgtagctgctgttttcccgattagaaaagaggtttggcttgaagattcggatgcaaagattatgaggggtgcagattttatattgtggtctgtcaattacatcgatactgcaggacaaacgctttatgaaagcaagactttaaggaaactcaaaaacctgtagaagtgcggataagccatttgctcatttcaaattattgtattcgatatctctacggatctgatggactgccttccgctgaagtagtttcgatgactcttgcagaggatgaatagaataatccagcagccacttacagcgcgccgggtaccaaacgcttttgaattcattaaaagaccgtcaggaggccctgatcagcgaaggggaatatgatgaagcaagggagcttatagcagcggagctagccggtttagacgaggttcaatcgcttaaataagcaggacaactgaataaaaacgcctgcgctgtaccgagccacgggtccctgggatggatgcccatgagtcaccaaattgccggacgccaggaatggagggaggataccctctattcccggcgcccggctttttattttggctgctgctcgaaatgaggggcaggcatggtacagagagaaacccgctgggttccccaaaaaattgcatttgtgcagcagtatcgctgccggtcccctccgcttcatgtcatttcaccaagagaaatgacatgaagaacggaggaaaggttcatggcaaaacatgaccaataccacattgactatgagaagctctatcccggcattggaaacaggcccgagatcttgaaagtcctggagcagagcgaccgaaaaatgaaatacatggaatatgacctgaagacaggacagccccatcgcagcagggaaaccggaaaccgtgttgttctgctggcacgggaagattctctggaacggctgcaggaggaagggcaagagcaattcccggatataactactttggaggagctgacagacgtccgggaagatatccggctgctgcgccacgcactgcttgaattagaggaaaaggaactgaatctgattatttccctatactacaaggggctgtctgaacgtgaatattcccaaaaaacaggtattccacagcgcacgatcaatgaccggaagcatcgtatccttgcaaaattaaaaaaaattctggaaaatcacaaataaaatccgctcaaacctctttctcaacggcttatatagtgaagggtattttcaaatgcccctgactgcagcttgaaaacagaatatccgaaggttgaaatactttccctgacgggcctcgaaaaccggggcaagcgatgccggaagatgcgctgggactcacctgcggcagcgcggagtaaacaagaaagcaccagctttcgttctttgggtttctccgcctcctgccgtcaacgacggccaaaataaggtgacgagcgggtccatctgtccgaaaagcagcctgtggcgggttgttttgccaagacgccgtcagcacacaatgatactcctgcccagccacagccgcaagcaatgggggcagctcgcagagaacctgggaggggtgaaagtcccgtgaagcggtgaagccagccgctgtttcaaccattcgcccacgcctgggggagttgtgtcgaatacaggcaatgaagataaatgacagaagcggcgggggtcgtatccaattgggaatttctccatgatccgtacaagagacgcggcccccgcctacataaaatacaggaggagaacatgaacctgcaaagaaaaacgcgccaaatccagcgcggcgatatctattgcgccgatctctcgccggttgtcggttctgagcagggcggcaatcgtcctgtcctggtcatccagaacaacaccggcaaccatttcagccccacggtaatcgccgcggccatcaccggccacaccaagcgggacaggcagcccacccatgtccggatcaatcattcaacctgcgggctgtttcaaaattctaccgtcctgctggagcagatccgcaccctggacaaatcgcgactgagtgaatatatgggccgtgtggatgatgagaagatgcgggaagtagatacagccctgggcgtaagcgttgggctgcaaaatacataggccgccccaactgcggcggcctttatctttatagggggaaccattatggatcagacaaaaatcaacatcgactactgcggcatccaaaaccttctccgcatactggagcagcacggattcagcaaagcggagctgaagaagatctccgcccggatcgccgcacagatgggcgcggacattattctcagaaacaaaaaacaggcggcatagccagccggctcctatgtatattttcccgcattttgagggaaaaactttggcaggtatttttctccctttgggtagctattaaaagcaaggtgtggtaatgtatactgctgaaaggaggtgaacaccatgagcaggcacaaaactgagggcagctcggcgctgcaggaaaggaaagtcatcgtcatcgaggcggcaaagaggccggaagcccaaaagctgcgggtagcggcctactgccgggtcagttccgactccagcgaccagctcaactccttcatggcgcagacccgttactacaccgatctcatctccagcaacggaagctggacgatggcggatatctacgccgacgagggcatctccgggacttcaatagaaaagcgcccggagttccagcggctgctcgccgactgccgcagagggcgggtcgaccggattcttgtaaaatctatctcacgcttcgcccgcaataccaaggaatgcctgaaaaccatccgctctctgaaagccattggggtgggggtctgcttcgaggaacagaacatcgacacctcgcagatgagcggcgaactgctggcggcgatgttcgccgccatcgcgcagaaggagagcgagagcatctccgaaaaccagcggtggagctatcagtacagaatggaaaacgagaaattcatcacctgcaaagcgccttttggatatcgtctgcacgaaaatacattggaggtttatgagccggaggccaaaattgtaagggaaatctttagccggtatcttcaaggggacaacaaggatgagatcgcgcagtggttgtccacacttggagtgaaaaccagggatggaaaagaccgctggcaacatacaaccatctcatatatgcttcgcaatgagcgatacatcgggaactcgctcctccagaaaagatataccacggattcgtttccccatcaaaaaaagcgcaatcttgggcaacgggatcagtattatcgtaccgccagccatccggccatcatcgacagagagatattcaatgccgccaaaaagctgctggaacttcgggcagaaaaagttaccgcaggaaaagcggcaaatgacccgatggctcaaaagatctactgcggcgcgtgcggtacaatgtttcgaaaaaaaacctgcggggggatcacctattgggggtgccggaatcatgaccgcggcaaagacaactgtcccatcacccaaatcccccaaagggaaatccatgccgctttcctgcgcctctgccacaagctgaagctgcacggcgaacccatcatcagggaactgctctccaacctccagacgatccgggaacacaggctgctctggagcgaggatatcatcgagctgaacaaaagaatctgtaaccttaccgatcaggaccatacactgtcccgcatgaatcaatgcgggcttgtagatcctgatatttttatctcccaacgcaatgagctggaccgtcagctcaccgctgccaaacaggagaagggacgattgctggcggcggccggcgacgacagcatcccaaagacaaaggagttaatggaggcgctggaatccatgcccgaatacctgccccaattcgatggggagatcttcggggatctggtagagaaggttgctgcggagagcagcaccagcctgcggttcatcctaaagaatgggctggaactgactgagaagattgaaaggacggtgcggtaatggcggcaaacaggaaactcccatttggatacgctatgcggatgggcaaaatctgtatccaggagcaggaggccgggctggtcaaagagattttctcagactacatccgcggggcgtccttcctgcggctcaccgggaaactgaacagccagccggtggcatacaacccgcaaacccgatggaacaagaatatggtcgcccgaatcctggaggacaggcggtatgtcggggaaaaggattttccgctgattattgagcaagacttgatgaatgccgcactcgcaaagagggcagccaaacagatagcctctcagccaaccgaactgcaaaagacgctgcgccagctgagtggccagaaggccatgcaacagatggaacaggaagtgcttacactccttgaccggctgatccggcagccggaatgtgtacagtttccctctcctgtcaaggtcagtccagaggaagaaagacggctcggtcaagagctggacgtcatcatgagccaacagccgatgggggaggaaaacgccaagcgcaccgcatacgcccttgccgccgcccggctgaacgccatcggttcggaggactatgaaaccctgcggatcaaagaggctctcaccagcgggatgccgccacacgacctgttaaaaagcatcgcgtccgccgtcctcatccgaccggatggggctgtggggctgcggctgaaaaacaaacagatcatcgaaaggagcaaaatatcatgaccgaaacagccccaaatatcattgtcatccccgcccatccggaaacggcaaagggcagggctgcccagcgccagctgcgggtagccgcctactgccgggtatccaccaaggacgaggagcagctcaccagctacgaggcccagcaagcctactacaccgatatgatcatgaagaaccccaactggacgatggcgggcatttttgcggacgaggggatcaccggcacctccaccgccaaacgccctgaatttctcaaaatgattcgcaaatgcaggcagagaaagatcgatctcatactggtcaagtccatctcccgctttgcccgcaatacggtggactgcctgggctacgtccgcgctctcaaggagctgggcatcgcggtggtgttcgagaaggagaacatcaatacgatggacacagaaagcgagatgctgctgaccttaatgggcgcgttcgctcaggcagagagcgaatcgatgagcgccaatatcaaatggggcaggcgccaggccatgcgggaggggaaggtcaccttccaatacaaatgcctttatgcctacgagcgtggcgaggacggcgagccttgcgtcatccccgagcaggcggaggtggttcggcagatcttcgacagcttcctcatgggacacagtatccgcatgattaaggccgagctggagggggacaagatcccagccgcggctggagggaaaagctggtcggaatcggccatccgaaatatcctcaaaaacgaaatatactgcggggatgtgctgttacagaaaacctatgtgagcgactgcatcagcaaaaggaccatcaaaaacaccggacagctcaccatgtacctcatccaaaatcaccatgagggaatcgtcagccgggacaaattcaacgcggtacaggctgagtttgccaggagaaacgccggccgcaccccaaacaagcggtacacctccactggccgttcctgttacagcggcaaatacgccctcaccgagcggttggtctgcggctgctgcggcaccctctaccgccgctgcatgtggaacaagcggggacagaaatgggcggtgtggcgctgcgccagccgggtggactatgggacgaaatactgcaaacactcgccaaccatctatgagaagcccctccagagggcgattctcgccgtcctcaactcggtgatgagcaaaaaggaggagctggccgggcagatcaccgacgctatgcggatagaactgctgtctctgcctggcgggacgatgagtatggcggacatcgaccgcaggctggcagagctggagcaagagttccaggccatgtttcagcggtccagagaaaagccggatgggtttatggaatacgcggagagtttccagaggatcaatgaggaagcggccaggctgaaggaacagaggaaataccttctggaccagcagcagagcgattcggcgacaaacggacggatcgcgcatgcgatggacgtcctgagtaccggcgcggcggaaatcaccgagtgggacgagagcataatccgccagctggtggatacggtgacggtgctctccgaggacagaatccgcgtccgtctgtatggcggcatagagctcgaacaggaactggataaggagagaaactgatatggcctgcgcaatcgaagatatccacgacaactacaaaaggttaccgctttgagcagcataagacgctccataacagagaaaagggcggcagctttaccgcttttttctttgggatggactttgcaaataggctctaaagctggaaaggaggaaccggaatgaacatccgaaaagagatcgactacagcgccatgtataccgcgctggacaacctcatggaacaggaacagccgcagatggatctgtatagcgggatcggcaggattgtctgtgacagggccgagaaaggcaccgcagtcgccgcggcggaatacctgcgggcgaagtacccggatgcgtccggtttttccccgcgcaacctgcgccggatgcgggagttttaccgcgcctatgaaaacagccttgccctgctgggtgaggccatgaggatcagctggacgcagaatgtggtgctcctggagtccggcctgacactggaggaaatgggctggtatattcgagctgtccatagatgtggatggacgaaaaagcagctgattgatgcgatttctgcaaaagaacacatcttctccctcgactgtcctctctcttcatgctatactgaggaggaaaatgaaactatggagaacgaggtacatgatcaaaatactgtttatctgccacggcaacatctgccgcagcccaatggcggagtttattatgaaagacctggtgaagaaggccgggctggaaaaagaatttctcatcgaatccgccgctgccagccgggaggagttgggcaaccccgtttatccaccggccagacggaagctggccgagcatgggatcagctgtaccggcaagacggcccgacagctgcaaaaccacgactacgagaagttcgacctgctcattgggatggatcgccggaacctgcgcgatatgcaaacgatctgcggcggggactttgcggacaagatgcacctcctgctggactataccgactgccctggcgatgtagccgacccgtggtacaccggcgatttcgaaacaacctggcgggacgtggaggctggatgcagggggctgcttgaaagaattaaccgcagggaagcgtaacaaaaatggagaaattggttgttcatggaacggaaatcaatgtgcagcgggctctcaaacgggacgattgtcttagcttgacagatatcgcaaaaatccaaagatagcggcaatccgcggtatatcactcaaaactggctgcataacagaaacacgattgaattccttgacgtgtgggaaacgctttacaatttatgaagaaagcggttgccgtattgactgtttgcactgttttatggtacactaatgtgaaaaattatacgagaacggagggataccgatgaaatgtaatctgatgcacaagcgcatcgctgtggcggaactgctgctcgatgatacgactggctttattcaaaaaatagacagggtgtttcagcccgaacatctgcccgtcggtgtctctgtgaaaaaagggatcgctgaccgcgccgccttaaacgaatggtggacggatcgttccatccccgccagccgttcgggaatccgagaggcgctggaaacgctggatatgaccagcaccaaaatgctgctggtgcgctgctacggcttaagcctctccgatcaatactggatttacccggaaaactcgaatctcacatgggatcaaatcaatttctttgaaaacccattttcggacgatatgggcgatgtgctgttcggcacacagaaaaaggcggacggtttcgatttcagttcgcccgacaacacctcagacggctgtctaaaaaaaagatggaaaatcctgaacggtaagcgttgtctcatcaaaggcggcagcaacccgttccgccagcagccttttaacgaggttatcgctgcggggatcatggaacggctgggcatcgatcatatcccctacacagtaatgtggaaagaggacgctccttacagtgtgtgcgaggacttcgtcacagcggataccgagctggtcagcgcatggcggattatgcagacacagaaaaaggaaaacagcacctcggtctatcagcattttgtgaattgctgcaaggcgctgggtgcgccgaatgttgtgccaagcctcgatcggatgatcatccttgattatatcatcgccaacgaagatcggcacttgaacaattttggcttgctccgcaatgccgaaacactggaatggcttgggttcgcccctattttcgacagcggctcctcgctgggctacgacaaagtggcggcgcagattcgtgctggacgggatatcgcctgcaaaccctttaaaaagcaccatgccgagcagctcaagctggtttcatcctttgactggattgactttgagaatctgaaggatgtagaatccatgatcacagcagtgctgtctgatgagaagaacggtgaatttatcgatgaaagccgaatctctgccatcgcttctgcggcagtcggacgagtacagacgcttcgtgagatcgccctgacgcacgcgccgaacctcgcagagatcactacagaggatgatgtggaagaaaacatcgcagaggactataccccgaaaatgggaatgtaaaaatgtaaatttgaatcagtcgttttgcagacaagaccttttcttatgtccaaaacgaatgcacaaggtcaaggtggttccaaactgggcagacttgccaccaggcaagggcctggagccaatttgtgctccaggctttttttcatatcaaaaagaaagcgcctgcgccctgcgcatagtgatttcggccgattgctgaacatcggagcaagcgatcgaaagcttgctccgattttttgaaaagtcagggcacgctcatgccgcctgccttttcaaattgctccaattccaagggcggacgcattctagtaagtgtacctgagcggtgcggccggacatccatttggtatgtccgcgtcatgaaaggtccatggcgtggtgcattgcaagtatttgcgacgttgggaggaagatgatatggcgttgtttaacaaatccgcaaatgaaaaacgccggcgcgccggccggcgtgtcgatccggaaacatatacggcggacggcacgccggtttaccgctatgaggatgcgcgtgaaacaggatggcggccgcccgcgccgacgctttactgtgaggaaatcgaagcgcatatggacagagctttttcagggcggcaggttcatgtgctgcatgaattgatgtcggattttatccatattgacctgcatgtgatggagccggatgctgccggcggatattttgtcctttacacgactggtatgagcgatttgcccatgtcggtgccgtgtgaagttcaagggcggaaaaaactggagcgggcggagctgatgatgctgttgcccggcgattgggacatgcaggcgctcggcggcgacacgcaggaagcctgctggcctgcgcgtctgctcaagtttctcgcacgctttccgcatgaatatgacacctggtttggcgcaggacacactattcccaatacagccgattatttaccttatgccgaaaatacggccctgagcggtacgctcctgatcgatcagccggcgcttgccggtccgcttgagacgcgtgacggcgtccgtatcaatctctacacggcgcttcctctataccgtgaggagatggagtataagcttgattatgggttggatgcgctgatggagcgcatggaacggtttaagccgtttatactcgatgttgcgcgcgaaaatgtctgtgcggacagcgcgccggagggcgtatgatggatggaagaagccgtgccgatataaaacccggcgcgcttgtggatattgttttaaaaaaggatcagccgaccggggcgctgacgcgcggccgtgtgtcccggattttgacaaacagccgcacgcatccgcatggtatcaaggtgatgctggaggatggccgtgtcggccgcgtgcaggcgatattggacgacgaataaggaggaacggcagatggttttatttttggaataccccaagtgcagcacctgtcaaaaggcaaaaaagtggctcgatgaaaacggtgtggcctatacggcgcgccatattgttgaacaaaatccgtccgccgaggaactgcgcgattgggcgcagcgttccgggctgccgctcaagcgttttttcaataccagcggcctgcgttataaggcgctggaattaaaggacaagctcccccatatgagcgacgaggagcaattcgcattgcttgcgacggatgggatgctggtgaagcgtccgttggtggtcggagacggttttgtgcttgcgggctttaaacccgccgaatgggagaggctcaaggcatgacgcgccgcctattttatgaggacgcctatatagacgcgttcgacgcggttgtaaccggctgtgaaatggtcgttgacgcatggtccgtcacgctggatcggaccgcgttttatcccgaaggcggcggccagcccggcgatacgggcgcgctcggcggcgtgcgcgtatgtgatacccaggatgggccggacggggaaatccgccatataaccgacgggccgctcgccgtcgggacagcggtgcacggccaaatcgattggccggttcgcttttcacatatgcagcaccataccggggagcacatcctctcagggctgctgcacagcctttatggtgttgacaatgtcgggtttcatatggggcgcgatgctgtgacgattgatctcagccgcgagctttcatgggatgaattgctgcacgccgaacggcttgcaaacgagacggtctggcgcgacgtgccggttcggatcgaatatccggacgccggggcgctggctgcgcttgcttacaggagcaaaaaggcgctttccggggcggtgcgtatcgtaaccgtaccgggcgccgatgtttgcgcctgctgcggaacacatacggcacgcaccggcgaggtgggtatgatcaagctgttgtcagcgcagcggtataagggcggcacgcgcgtatggctctgctgtggcggccgcgcgctcaaggactatgaagcgaagaatgcgtcggttcatgcgatatcggcgcttctgtccgcgaaacccggcgaagttgccggcgcggccgcgcgtatgcagcgggagaatgaggcgctcagacaacggctttccacgctgcgcaggcagcttttcgcataccgcgcgaaagaagttgagcagggcgcgcgctgcgccgttttattcgaggaggcgatggaaccggccgatttgcgtcacctctgcatggcgcttaccagccgatgcggcgtggccgctgtgctggctggcggcgaaggggaccgctggagctatgcggtcggcagcgaacagacggatgtgcgcccgcttggcgttgcgctcaacgaaacgtttgacggccgcggcggaggaaagcccggcctggtgcagggtacgctgaccggcgcgcgcgaacagctttcccacttttttgaaacttaccttttttgaaaaaaaggtaagccaaaaaactttaatcggctgcgctgcgaacagtgggacagccgtcggttgttagataggctttgccgcgaataatggggtggcgctgcgtaatcggatttcacgccgcggcgatcaaaagttttcgcccgcctttttcaaaaggcggcgggtgaaggcgggagccaaagcccttcgcgggctttggctcccgccgagggcagcgccctttaccccgggccgcagccctcataaaaagcgcggtccgcaggccgcaagagcctgcttagacgcaccgcccgccccctgcaaaatccatgacagacgccgcgcggctggcatggattttgcaggcgctaacttttataaaaaacgttccggcgaaaatgccagccccgcgcgcagtatagaaatggatggtctgatatgaatatacaaatttatgggaagtcgaaatgctttgatacaaagaaggccgagcggtattttaaagaacgcggcgtcaaattccaaagcatcgacctgccgcgctacggcatgagccgcggcgagcttgacaatgtgcgccgcgctgtcggcggattaaagccgctgatcgacgagaaatcaaaggattacgaccgttcctatgtcgcctatctggccagcgaggaagcggtgatcgaaaagctgctggagatgccgtccgtgctcaagacgccgatagtacgcaacggccgtcaggcgacggtcgggtactgtcctgagatatggaaaacctgggaataaaacgcatggctaaaagcggcggacatattccaggcgatgagggagaggtatgatggccggtaaattcagcgcgcttcaggtggcgcatgatttcatcgcgcggcatgtaaagccaggggatttctgcatcgatgcgaccgcgggccgcggacacgatacggcgtttctctgctcgcttgtcggcggatctgggcacgtgcttgcttttgatatccagcaggaggcggttgacagcacaaccgaactgctgcatacgcgcggttttgcgggaattggatgcgctgtgctcgacagccacgccaatatggctgcatatgctgcgccggaatcagtgagctgtatcacatttaatttcggatggctgcccggcggagatcattcaatcaacacgcgcgcagaaagcagcatcgccgcaatcgaagccggccttaggctgttaaagccgcgcggcgttatgagcttatgtatttactatggacgcgacacgggctttgccgagcgcgacgcgctgatggattattttaaaacaatcgatcaccgcgcctttaccgttatcacggcgcagtttgccaaccgtccgaattgcccgccgattccggtcatgatcataaaggatgcataagcttgccgtccagactgccggatggttagttgcattttgattttattgccccttgactctaacattgtgtcatagtgtatgcttacgttgcgcgcaaagatgtaagaaggaaaggggcggctttgcatgttcaggatcggcgaattttcccggctggcgatgatcagtatccgtatgctgcgccattacgataaacttggcctgctgcgcccggggtatatcgacccggattcgggataccgctattatgaggcggcgcagctttgtacagccggacgtatccgcgccttgcgggcgctgggctttggcctggcggaaacgtccgaaattctgacccggtatggcgacgcggacagtctgcggcgctatctgatgcaaagcctttcccgcacgcaggcgcaggcgcgggtgctcgaggcccgcgccgtgctgcttgcatcggccatcgaacaggtgggaaaggatgaaatgtttatgaattatccggttgaatgcaagaaattttctgtcagaaaggcgtactgcctgcgggatatcatcccgcgttatgaggatgaagggattctttggcggcgtctgggcgaacaggtcccggacgggacgtatcaggctgtatcggtatatttcgacgaaggctaccgcgagtcggatgtcgatgtacaggtatgtatggtttcggatgcggcagacccgtcccatccgctttactgtgagcttgcggcggttgaagcggcgtcgacaatggtgcatggccgccatgatcaaacctcagccgcctgcgcggcgctcggcgcatggatcgaagcgaacggccgtcagatcggcggctgcatgttctcgatctatcatgtcagccccgcgatggatcaaaatcctgacaattgggtgacggaagtctgcctcccgctccagcccccgcttttttgaaccttaccttttttgaaaaaaaggtaagccaaaaaactttagtcggctgcgccgcgaacagtggggtgggttccggatttttacaggctgcgccgcgaacagtggggcgggttccggtacttttacaggctgcgccgcaggcagcgaggtatctgccgcggatagatggacggcgttttgcggctgtgaatacaggttctaaagcattcggcagacaaaaaaagatcagctccatgccggttgggcatggggctgatctgaatttttaaaaaaggatggatgccctcatgacgtttgatgaaagcgtttacgcggctgtccggctgattccgcgcggccgcgtcgccacctatggccaaatcgccctgctgtgcggaaatccgcgcgcgtcgcgcgcggttggctgggctttgcggcgcaacccctcgccgggggcggaaatcccatgccaccgcgtcgtcaaccgcgagggccggctcgcgccggcgttcgcgttcggcggaccgggagcgcagcgggatttgctcgaagcggagggcgtcccgttttttgcagacggccgtgtcgacctgaagcggtgcgcatggtacggcccaaaggaaggcggatctgtttaagcttcagagcacggtctggccgttgataaccaggcggaatttaaggcccaggcgttcggccgccttgcggcagagcagcatacggtcgaggaaaatttcgaaataatccatgactgaggaaagctccgtatcaatgcggatttggagtgtaatcgattttttgtcgccggagattgccgtggaggattcttcaacagcgtagttgacacggtcatggatatcaaaggttgccatatcgcggttgcgcacgcgtgtgcggcgcacatctgtcttgtccgccagaatcagcgcggcggccacagcatccaccgccacggccgtaccctcgtcgtggttgccgatcgcgctgataatggttgcaatgtcctcggcgtccgcgcccatgttgtccaacaggcgaaacgccatgacggcgccgctttgcgcatgatcgacgcggttgatcacattgccgatgtcgtgcagatagcccgcaatctgcgccagctcggcggtacgctccggatatccgagcgtcagcagaatatcgcgcgcctgccgcgccaccttgccgacatgcgcgaagctgtgctctgtgaagccaagcacccgcagcgcgtcgtcggccttgcgtatgtatgttttgatctgctcgttttcaaagatctgctcaaaagtaatcatcaggtcgtctccatttcattcatctgtttcctgtttattgtatccctgccgcttgtaaaaaacaatcgtccgccgttatctttataaactttttacaattggtatacgccaaaacagcccgctaggtctggttctccagaaaaaggttgtgttatcgggaaaatcgtactataataaaatgtatcttttgagtatacgatggggaagtgtctttttacaatggggtacagcttcaaaaatgattacagcgagggcgcgcatccgcgggtgcttgaggcgctcacgcgtacaaacgctgaacagaccgacggctacggtaccgacgattactgcgcgcgcgcccgcgaacgggtgcggacgctctgtaacgcgcccaaagccgatgtgcattttcttgtgggaggcacccaggcgaatatgaccgtgatcgctgcgtcgcttcgcccgcatcaagcggtactggccgcgcatacgggccatatctgcgtgcatgaaacaggcgcgattgaagccacgggacacaaagcggtcggccttgcttcacttgacgggcgcctgtccccaaaggcggcggccgaggcgcttgccgcgcatcctgacgagcatatggtccagccgaagatggtttacatatcggatacgaccgagatcggcacaacgtatacgctcgggcagctcgaggagctttccgctttttgccgcgccaacgggctttggctgtatttggacggcgcgcgcctggcgatggcgctggccgatgggcacagcggcgtgacgctgcctgatctggcgcggctgtgcgatgtgtttacaatcggcgggacaaaatgcggcgcgctgttcggcgaggcggtcgtcatcacaaacgacgcgctcaagccggattttcgctatcacatcaagcagcgcggcggtatgctggcaaaaggccgcctgcttggccttcagtttgaggcgctgctggcggacaacctgtatacagagcttggcgcgcacgccaacgcgatgggccgccgcctgcgcgatctgttcacggaaaacgactatcccatgatgagcgattccctgacaaaccagcagtttgccgtgctgcccgaccggctgatcgaggcgctcagggctgcagattacaggtttgagcttcagatgcgtgtcgacgagacgcattgcgcgatgcgtttcgtcacatcctgggcgacgccggaagcggctgtcgaacagtttgccgacgattttctgcgcctggcgcgccagtgcggcgcgtgagcgccgtggacgggccgcgcgcgctgcgcggcggtccgctgacgcatctgctcgcggtgtgcgccgtctttttgtggggaacggcgtttccggccgtcaagcgcgggtacgcgctgtttttgctcgcgccggacgatatggccgggcgcatggccttcgcgggggagcggtttgtgctcgcgggggcgctgacgcttgtctgcacggccgtgctcacaagacggccgccgaccatcccgcgcggccggtggggcggcgtggcgctgcttgcgcttgtgcagacaacgctgcaatacctgttcttttatgccggcatggcgcatactaccggcacgaaaggcgcgatcatcgattcaagcgccgcgtttatcggcgtgctcctggcgcattttctgtgtgccggcgaacggatgaccgcgcgccgcgccgcaggctgcgccgtcggtttttcgggcgttgtgctcgtaaacctcggcgcaggcggcatgggaggcttttcatggcgcggcgatgggctgatgctgctggccgcggcttcgttcgcatttggcggcgtcatcagcggccgtgcggcgcgcggcctggacccggcggccgtcaccggctggcagctgctcggcggcggcgcgcttttgctggcgggcggcgctgcgatgggcgggcgcgcggtcccgccgtccggggctgcgtggctgctgctcggatatcttgccgtgctgtcggccatggcgttcacaatctggacgcttttgctcaaatacaacccggtcgccaaaatcagcatctacaattcgctgacgccggtgttcggcgcgctgtgctcggcggttgtgcttggcgaacggtttttcagcataaaaaacctggcggctctggcgctcgtctgcggcggcgtttatctggtcaactgcgtcccggatgggacgggaagggggaaaacggaacgtgtatgatcttttgatccgcggcgggacggtcgtcgatgggagcggcgattccgccgtaccggccgatgtggcgatcctggacggcaaaattgcggctgtcgcgccgcgcattgagagcggcgcggcgcgcgtgatcgacgctgcggggcggcttgtgacgccggggtttatcgatattcaccgccatgccgatgtgcggctgttctccccggactttggagaagctgaattgcatcagggcctgacgacggtcgtcaacggcaactgcgggctgtcggccgtgccgtgcccggccgcgcggcgcgatgaaatccatgcgtttttgcagccggtaatcggtgatgtaaacgcgcccgcgccgtttgagacgtttgcggagtatctggcgcttgtgcgccaaacgccgctgccgctcaatgtcgggatgctggtgggaaacgggacggtacgcgctgcggtgcgcggctatgcgccgggcgtcctgacgccgggcgagcttgccgctgcgcgtggcctgctggaggacgcgctggccaacggcgcgctcggcgtgtcgatgggtatcgtttatgcgccggaatactgctacgacgccgacggctttgcgcaggtgctcgcgcccgtgcggggggccggcgtgccgctggtcacgcatgtgcgcggcgagggcgacacgttccaccagtcgcttgacgaggtgatcgacgtcgcgcggcggctcggcgcgccgctgcatgtcagccatttcaagtgtatcgggcggcgcaattgggggcatgggatgacacgcgcgcttgaaatccttgatgaggcgcgtgaaagcggcctgcgtgtcgactgtgacgtctatccgtatacggccggctcgacgcagcttttgcagatcttgccgccgtggtttctcgacggcggggcgcccgcgatcacgcgccgcctgcgcgacccggcaaaggtggacgagctgcgggggatttttgcagagccgtctggccggtttgaaaacctcgtgaatctgatcggctgggagaatatccgctgtaccacgttcacacggccggagaaccaggcatataccggcatgagcgtggcggagatcgcggcggcgcgcggcgaggacccgtgcgcctgcgcctgccgcctgcttgccgaggaggagtgccggatttcgatggtcgatttcatcacctccgaggaggatatccgcgcggtgctgcggtatccgtacagcaatgtgatttccgacgcggtctatccgtccggcgggacgccgcatccacgtctgtacgcggcgttcccaaaggtgctgatcgattatgtgcgcagagagccggtactcacgctggagcaggctgtccacaagatgaccgcccgccccgcttcggtgctcgggctgcgcggcaagggcctgctccggaagggatacgacgccgatatcaacgtatttgaacttgggcgtctggcggcggacgcctcgtatgaaaacccgtctgtgtttgcaagcggttttgattatgtgtttgtcggcggtgcggcggctgtcgaacacgaccggataaccggcgtgcgcgcgggccgcgtggtgacgcggtgagcgcgccgaaggcgctcgggccgcggcggcccgagccgccgcgtatgccggcgctgtcccctgcgccgcccggcgcgttgcgcgggctttgggcgcacggcgcgccggctgaggggctgcagatcacgcaggcgtgcggtttgccggatggacagcctgactgcgaatgtacgggctgtgccctggagggcgtttcgctcgacgctttagagctgccggaggcgcgtttcgccgacacggcgctgcgccggtgcggcttgactggcgcacatctggagaagggcgcgtttacgcgcgtgcggttcgagggcgtccgtttttccggcgcgtcgctggctaagtcgttttttacagatgtgtcgtttgtgcgctgcgatttgtcgaacaccgatctgcacggctgttccatgacgcgcgtcctgtttgaggactgccgcctgaccggcgcggatttcggcgaggctgcgctttcggacgcgctgtttaccggctgcgcctgcggttatgcgcagttttcgcgcgcgcagcttcgggatacacgctttgagcggtgcgactgcgccggcgccgcgtttcacgagctgcgttggcgcgccctgacgtttgaagtgtgctcgcttatggctgcggagctgtttaaaacgccgcttgaggggatggatttgacaacctgccaaatcgatggcctgatcgtcgatccgccgagcctgcggggcgcggttgtcaccgccgtacaggcttgcggcctggcgaagctgctgggcctgattatccgctgaacagaagaaccgggcgctttggcggacaggattcggacacagatcccagggaggagatagcatggaggaactaattttatcgctgcgcgacgttcacaagacctttggaacgaccgaggcgctgaccggcgtgagccttgacgtacaggcgggcgaatttttgacgctgcttgggccgtccggatgcggcaaaacgacgacgctgcgcattattgcggggcttgaagcgcccgacggcggccgcgtgctgctccagggcagcgacgtgaccgactgggagccgaaccggcgcaatgtcaacacggtgtttcaaagctacgcgctgttcccacatatgaacgtcgcgcgcaacattggatatggcctgcggctgaaaaagacgccaaaggatgaaatccgccgccgcgtcgacgagatgctttcgcttgtgcagcttccgggctacggcgcgcgtatgccgtcgcagctttcaggcgggcagcgccagcgcgtagccattgcgcgtgcaattgtcaacgatccggccgtgctgctgctcgacgagccgctcggcgcgctcgatttgcagcttcgccgccagatgcagacggagttgaaaacgcttcagaaaaatttgggcatcacatttatctacattacgcacgaccaggaggaagccctcaatatgagcgaccgcatcggcatcatgaacgaggggcgcatccttcagctcggcacgcccgacgatatctatgagcgcccgcagacgcgtttcgccgcggaatttatcgggcagagcaatatctttactgcaaccatcaccggccgcgacgagacaggcgcgctgacgctggcgtttgccggcggcgtaatcaaagcggccggcgacggcacgccgggcgagcgcgtgacgatctccgtgcgcaccgaacgcatccgcttcggtgaggagagccgttacggcttcgatttgacgggcgtcgtacaggcgcacagctatacgggcgggatgctgcgcacaacactgcgcttggctgacggtcaggaattgaccgtcagcggcatgggcggcggaggcgatcgggccgaggtgggcgaaacggtgcgcatccattggaagccggcttgtgccgtgatcgtggaaaggggcggtcatccatgaacaaaagacgccggttcccgctggcggccgcgccgtttatcctgtggacggcggtgttcgtggcggtgccgctgatctatatcctgtgcatgagctttatgcgccgcgccgatacctggggcgttgaggcggcgtttacgctggagagctatcagaagctgctcgacccgaattatttaagcgtctttggacgcagcctgtggctggctgtgctgacgacgctgctgacgctcttgatcggctatccgttcgcctattttaccgccgggctgccgccgaaaaaacggtcgctcgcgttgatgcttgtgatcgtaccgttttggacaaattcgcttgtgcgtatttacggctggatgatcctgctgcgcggacagggcgttgtcaattcgcttctggctgcgctcgggctgattgacgctccgctcaagctgttgtataattttggtgcggtgctggtcggtatggtgtatgcgctgattccgtttatgatcctttcggtttacaacgcggtggccaagctggaccctgcgctcatcgaggcggcgcgcgacctcggcgcgggccgctggcgcgcgttctggacgatcaccgttccgatgacgcgtgcgggcattatggccggctgcgtgctggtctttatcccgtcaatcgggttgttctttatttccgacctgctcggcggctccaaaaccatgctgctcggcaacctgatccgcgacgagctgctcaccgcgcgcaactggccgcttggcgcggcgctgtccgttgtgatgatggcggcgaccctgctcgtaatcggcgggtaccgccgcctgtccggcgaaaaaagtctggaggggatcgtgtgaaaaagcgttcaaggttccccgggatttacgtcgtgctgattctgctgctgttgtacctgccgatcgcggttgtcatcgcttattcgtttaacgatacgaagctgttccattgggcgggcttcacattttcctggtatggaaagctcttccacaaccaaacgctcatcaacgcgtttttcaacagtttggagctggcgctgatcagcagcgcgtcggccgcggtgctcggcacgctcggggcggtggggctgtccggccgccatttcagggcgcgcggcgcgcttgaaaacctgtccatgatcccgattatggtgccggagatcatcctcggcatggcgtatctgtcgttttttacgtttgtacgcctgcccgccggtatgctgacgctggtgcttgcgcatacgaccttctgtgtcccatacatttttatcaatgtcaaggcgcgcctgtcggcgctcgatccgtcgattggggaggccgcgcgcgatctgggcgcgtcggcgcagcgcgcctttttcgacatcacgttgccgctgatcgcgcccgcgatcctgtcgggcgcgctgcttgccttcgctatgagcatggacgacgtggtcatcagcttctttgtcacgggtgcgcagacaagcacgcttccgcttgagatttactccatgctgcgcatgggcgtcacccctgaaatcaacgccctgtgcaccgtcctgctcggcgccgtctttctcctcgttgcgttctcccgtctttttcaaaaaagctcccgttcccgcttttttgaaaaaaagcttggcaaaaaactttagccgactgcgccgcgaacagtggggcaggttcagttaaacaatccctctccagacgtactggcgtgcgcccgatacgatcgcgccaggcagaggtggggataacataaggggaggggtcgctcgaccctccccttgtgaggcgcgctgaggggcgcagccgcagcttgtccgcgcccggcgcttatagcgccggaaagccccgaatagccggacgggcaagcgcagcgcccggcggtgagcaatccgcgcacggattgcgcgcgccatagcgctgcacggatggcatggattttgctcccctggcctttcctgggacagacaacgtataaaaaccggccgcgccgctgctgcgaataaaagatcattgcgctgaaaaatgggaacagtccggcggttggatacggttgacaatatgcaataaaacagaaggagagaagaaatgaaaaagacaaaacgaatcctggcgctgctgatggcggcggtattggccttagggctggcggcatgcggcaaaaaggctgatgagaaggtcctcaacatcttcacctgggccacgtatttcccggacgatgtgcttgccgagtttatggaacagacgggcatcaagatcaattacagcgtgttccagtcgaatgaggaaatgctcatgaaaatccagcagggcggagattacgatctggtgctggccagcgactatatcatcgatatcgcgcgcagccaggatttgctgatgaagctggataagtcgaagatccccaattttaaaaatatcaacccggctttccagggcaagttctatgatgaaaacaacgaatataccgtcccgtattcggcgggcattccgctgatcatctacaatcccgagctggtcggcgatttggagatcaccggttatgaagatctgtggaatccggcgcttgccgattcggtcgttgtgatggacgacgcgcgcaatgtcatcggcatcacgctgaaaacgatgggcaagagctttaacgagacggacccggctgtgcttgacgaggccagggaaaagcttctgactctgcgcccaaatattcgcgcgcttgattacaacacgccgtataacctgatgttaagcggagagacatccgtcggttatatgtttacgtcgcaggtgctgacggtcctcaacgagaaccccaattttgaggttgtgttccccaaggaagggcttggctttggcattgattcctgtttcattccagccaaagcgccgcacgccgacaatgcgcacgcgtttttggactttattcttgacggtgaacgctcggcgcatatcaccgaccagatttattatatcagctgcaattccgccgcgacgccgtacctgtccaatcaggcgctcgtcatcccggatgaggcgattgcaggcgcggaattcattatggatgtcggtgagacagccgatctttataacgatatctggaccgaatttaagcagagctgacactccgcgtaaaaaaggcgtccctgatgggggcgctttttttatagtgcgggacaaattgtaattgatgggaaatagttcaatttaattgtgcatgaggcacaatgcagcgacaaagaaaatgttaaaactgcaaaaatgtttgtctactaaaacggtatttttgtaagaaatgaatggatttcttgtgaaaatgcctagacgcgctcctatgaatctgatataattataacaattacgttgaccgcgcgcggctgttccgcgcgcaaccagatttgaaggaggttttcaatcgaatggcgaacaccaaaaccgtggtcccgttcaccggcactgcggagcaggaggcgaagctccgcgaggtgattgcggctcacaaagggcagaaaggcgcattgatgcccgtgctgcagggcgcgcaggaaatctacggctatctgcccattgaggtgcagaagatgatttcagacgggcttgatatcccgctggaggaaatttacggcgtcgcgacattttattcgcagtttacgctcaaccccaaggggcaatacaaaatttccgtctgcctgggtaccgcttgctacgtcaaaggcgcgggcgatatctttaaccgcttgcaggaaaagctcggcatcgaaagcggaatgtgcacgccggacgggaaattcagcctggacgcctgccgctgtatcggcgcctgtggactggccccggttatgacgatcaacgacgaggtctacggccgtttgaccgtggacgatgtcgacacaatcctcgcgaagtacaggtgagtttgaatgcaggaattgtcgctgaatgtgctggatatcgctcagaattcggtgcgtgccggcgcccggttgattgagattatggttgatgaacagccggaaagcgataccatgacgattgcggtggccgatgacggctgcggtatgacgcccgagcaggccgcgcatgtgacagacccgttttttacgacgcgcacgacgcgcagggtggggcttggcgtgccgtttctgaagatggcggccgagatgacgggcggcggcctgacaatcgaaacggctcctggtcgcggcacgacggtgcgtgccgtgtttggcctgacgcatatcgaccggatgccgctgggggatatcgctgcgacaatctgctcgctcatccaatgcaacccggagatcgactttacatatacgtaccgccgcggcgagtcctcgtttacggcggacacgcgcgaattttgcgcggtgctcggcgacgtgccgctttccaatccggaggtggtcgcgtttatcggttcgttcatccgggagaacacgcaggaaattacggcgcaggcgcagtaggcgccgcgctatgcgaacgggaggaaacgctatttatgaaaagcttggcggagcttcaggctctcagggataaggtgaaaagcaatatgggcatccgtgccgacgacagcggcaacacgcgcgtcgtggtcggcatggccacctgcggtatcgccgccggcgcgcggccggtgcttgccgcttttacggacgaggtcgcgcggcgcggcgtctccaatgtgacaatcgcgcagacaggctgcatcggcatctgccagtacgagccggtcgtcgaagtgttcgagcctggcagggaaaaggttacatacgttaaaatgacgccggaaaaggctgcgcgcgttgtcgccgaacatctgatcaacggcaaaccagttgcggaatacaccatcggcgcgatgaatcaataaaaaggaggatctgcatcatgtatcgttcccatgtgctggtctgcgggggtactggctgtacatcctccggctcagtcaaaatcatcgaggaatttgagcgcgagcttgccgcgacaggtctgacagaggaggtcaaggtcgtcaagacgggctgtttcggcctgtgcgcgctcggtccggtcgtcatcgtctacccggaaggctcgttttattcccgcgttaaggcggaggatgtcaaggagattgtcgacgagcacttgctcaaggggcgcatcgtcaaacgcctgctgtacaccgagacggttgccgaggataagatcaaatcgctcgaccagaccgacttttataaaaaacagatgcgtgtcgcgctgcgcaactgcggcgttatcgacccggaggatatcaacgaatacatcgcctacgacggctatcaggcgctcggccgggtgctgaccgagatgacgccggacgatgtgatcgaaattctcaaaacgtccggcctgcgcggccgcggcggcgctggtttcccgacatggctcaagtggaactttgccaaggcgcagcctgccggtcagaaatatgtctgctgcaacgccgacgagggcgacccgggcgcgttcatggaccgttcggtgctcgagggcgacccgcacgccgtgttggaggccatgacgatcgctggttatacgattggttccaaccagggatatatttatgtgcgcgcggagtatccaatcgctgtcaagcgcctggaaatcgcgatcaaccaatcgcgtgagatgggctttcttggcaaggacatctttggctccggctttgacttcgacatcgagctgcgtcttggcgcgggcgcgtttgtctgtggcgaggaaacggcgctgatgacctcgattgaaggccaccgcggcgagccgcgcccgcgcccgccgttcccggcggtcaagggtttgtttggcaagccgtctatcctgaataacgtcgagacgtgggccaacatcccgcagattatcctcaagggaccggagtggttcgcgtcgatgggcaccgaaaagagcaagggcaccaaggtgtttgcgctcggcggcaagatccacaacacggggcttgtcgaggtgccgatgggtacaacgctgcgcgagatcatcgaggagatcggcggcggcatcccgaacggaaagaaattcaaggccgctcagacgggcggaccgtccggcggctgtatcccggcgtcgctcatcgacacggagatcgattatgacaacctgcttgccatcggctcgatgatggggtcaggcggcctgattgtcatggacgaggacaactgcatggtcgatatcgccaagttcttcctcgaattcaccgtcgacgagagctgcggcaagtgcacgccgtgccggatcggcaccaagcgcctttatgagatgcttgacaagatcacccgcggcaacgccacgcttgaggatctcgacaagatggaggagctgtgctattacatcaaggaaaacgcgctgtgcggcctggggcagaccgctccgaacccggtgctgtccacgctgcgctatttccgcgacgaatacattgcgcatgtcgtcgacaagcggtgcccggcgggcgtctgcaaacatctgcttcagtaccgcatagaaaaggaaaagtgcaagggctgtacgctctgcgcgcgtcagtgcccggtgggcgctatcagcggatcggttaagaatccgcatgtgatcgatcagaccaagtgcattaagtgcggggcctgcatggagaaatgcaaattcggcgcgatcgtcaagaaataagaaaggagtgtaccaacatggaaaaagaaatggtaaacataaaaatcaacggtatgcccttctctgtgccgaaggacagcaccatcctggaggccgcgcggtacgccggcatccagatcccgacgctgtgctacctcaaggagatcaacgcgatcggcgcgtgccgcatctgcgttgtcgaggtcaagggcgcgcgttcgcttgttgcggcgtgcgtgtatccggtggccgagggaatggagatcatcacaaactctaagaaggtccagcaggcgcgtaagattacgcttgagctgattctttccacacataaaaaggaatgcctctcctgcgtgcgcagcggcaactgcgaactgcaaaagctctgccacgacttcaaggtggacgatgagcaccgttatgacgggaacaatcctgaatggccgaaggacgattccgcggtccacatggtccgcgacgacaacaagtgcatcctttgccgccgctgcgtcgcggcctgcgccaaatggcagggcatcggcgtcatcggcccgaacgagcgcggctttaatacgcacatcgcctgtgcgtttgagcagaaccttgacgaggtcgcctgcgtaagctgtgggcagtgcatcgttgtctgcccgacgggcgcgatctatgaaaaggatcagacggacgaggtttgggcggcgctgaacgacccgtccaagcacgttgtcgtccagacagctccatccatccgcgccacgctcggcgaggcgttcggaatgccggttggtacgaacgtcaccggcaagatggtcgccgcgctgcgccgtatcggctttgaaaaggtgtttgatactgatctcgccgccgatatgacgattgttgaggaggcgcacgagtttgtcgagcgtgtcaaaaacggcggcgtcctgccgatgatcacctcctgttcgccgggctggatcaaatactgcgagcactatcatcccgatatgatcccaaatctttcgacgtgcaaatcgccgcagcagatgttcggcgcaacggtcaagacctggtacgctgaaaagatgggatgggataaaaaggatatcgttgttgtgggcgttatgccctgcacggccaagaagtttgaagtgcgccgcgacgacgaggacgcggccggttccggtatcccggatgtggatatcgcgctgacaacacgcgaaattgcacgtatgatcgaccgcgcgggcattcagtttacagagctgcccgatgaggagtttgattccccgatgggcgagagcaccggcgccagcgtcatcttcggcgcgacaggcggcgtcatggaggcggcgctgcgcacggcggcggaatgggtcggcggcaagccgctcgagcaggttgagtttaccgatgtacgcggtacggccggcgtcaaggaggccagctaccagatcggcgacctgacagtcaatgtagccgtcgcttcagggcttgccaacgcgaagaagctgctggagcaggtcaagagcggtatgaaaaattaccactttatcgagatcatgggctgtcccggcggctgtgtcaacggcggcggccagcctgtccagccggccagcgtgcgtaattttgtcgacctcaagtccattcgcgccaaagctctgtatgacgctgacgaggcaaagaccctgcgcaagagccatgaaaacccggcgctgctcacgatttacaaggagtatttcggtgagttcggcagccatcttgcacatcggatcctgcacacaagctacacggagcgttcccgtttctaggctccggctttttcccggccttattgaaaaaaggcttcggcgaaaaactgcataccttttttgaaaaaaggtatgtctaaaaactttcgccggctgcgccgcgaatagtggggcagcggcttctgaaagggattttatgtacccggcgggcgtgagccgttacggctgcgctcgaagatgtgccgtataagagggcggattaaatcagttgcctctatatgattaaaagaaccgccggcatggccggcggttcttattttagcaatcaaaaaaacagaggagcgcccggcgctcctctgttttgcgtctgaaagggcggcagcgggccgcgcccgcgcatcgccctggctatgggggaaaaaataatcgcgctgcgattattttttcaaggcaatggcctgcttcgccttggcggcgatgccctccggcgtaaggtgataggctttcatgacaagcggggctttgccgctgcggccgaattcatcgtttacaccgtgcttgaccaccggggtcgggcagttttcagagaggaattcgctgacagccgcgccaagcccgccgatcacattgtgttcctcggaggtgacgatgcagccggtttcctttgcggctttgagtacaatttccgtgtcaagcggcttgatcgtatgcatatcgatcacgcgtgcggagataccgtcagctttcagcagttcggcggctttgagcgcctcttgaaccatcatgccgaccgcgatgatcgtgacatccttgccgtcggcaagctggacgcctttgccaagctcgaaccggtagccaggaattgaatcggtgaccgtttcgactgcgaggcgcccaaggcgcatataggctgggccgtcataattaagcagcgcctcgacagcggcttccatctcgttgccgtcgcacgggcacaggaccgtcatgccggggatgacgcgcataagggcaaaatcctcgatgcactggtgcgtcgcgccgtcctcgccgacggacagaccgccgtgcgaaccgataaccttgacattgagacgcggatatgcgaccgagttgcgcacctgctcataagcgcggccggcggagaacatggcgaaggaattggcaaacggcatcttgccgcaggtggccagaccggcagcaatgccgatcatatcggcctcagcgataccgatgttaaaaaacttgtcgggaaacgccttggcaaagctgttggtcattgttgcaccggacagatcagcatccagtacaaccagctttggattctcaccaaatttcacgagcgccttaccataagcggcacgcgtagcaatgacttctcccatcattaaccctccagacctttcaaagtagcctcaagctcggctttcgcggtttcatactgctcgtcattgggcgcttttccatgccagccggcgttgttttccatgaaggaaacgcccttgcctttgaccgtcttagctaaaatcacagaaggcttgcccttgcaggcggccgcggcgtcaaaggcatcggagatagctgcgatatcgtgtccgtcgcatttaatgacgttccagccgaacgcctcccatttctgatcgagcggctcggacggcatgacgtcggctgttttgccgtcgatttgcaggccgttgacgtcgacaacgccgcacaggttgtccaaaccaaatttggcggcggccattgcggcctcccaaatctggccctcctcgatctcaccatcgcccatgaccgcgtaaacgtggtaatccttcttgtcgatcttgccggagagcgccatgccgactgctacggagagtccctggcccaaggagcctgtcgacatatcgacgcccttgacataacgcatctcggcatgtccggaaacatgaccgtcgatgctgcggaacagcttgaggtcatcgacagggaagaagccgcgcagtgcaagcgttgggtacagcgcgggtgtgcagtgcccttttgacaacacaaaacggtcgcggtccggatcctgtggattttgagggtcaatgtgcattttgtcaaaataaagaactgtcaaaacatccgtaaccgacagcgaaccgccgatatggccggacgccgcggtatgtaccgcctcaagaccagcgagtcggatctttgccgcggtgattgctaattccttggcgcgagtttgctccattttgctcatcctttcacctgttcggatacgatatttccagacgccgcgaccggcggcgcccacataaatacctattataataataatacaaacgatttggataatcaaggtatttcatcgttatctttgtatgaccgctgtcatgtggttcaaccggttccgcctgaaaataaaatcgatttttcgatttttcgattggaatcgattgacaggagcgccgttatctgatataataaaaatctatttgaatgcttaaacagaggataaacagaacgttgctgaaatgtgttctgttttccaaagtttagccttcagcttttaaattgcagcggtatcgaagtggtcataacggggctgactcgaaatcagtttgggagcaatcccacgagggttcgaatccctcccgctgcgccagcaaagaaacctgtttttgacttaggtcaaaagcaggtttctttctatttcgagacaattgtttttacagaaactctaaaattagaggattatagcaggttccgttgccctttggccagtttataatccacatatccttgacttctccatgataccttagagaaaacttccatataagtaacattaaaaattcagagaggagcatcttcgccataggcggtcacatacggatattatctcgcgccaaatggctatgtggccatcgatcaggaaaaagcaaatatcatgagaataatttatcagcgatacttctccggcatgagccagggcggaatcgctaattttctttttgagcagggtatcccatctgccaaaggaaaggaacgctggacacaggatgagaacactaatcggaagaatggctacctggtacagctcgcagagcctactgggcggccttttgtttgtgcggaatgcgggcacagctaccgtcacattacccggctatccgtcgggatcatttggcggtgtaccagccggatggagcatggcaagtaactttacaagaactcgccttctgttccaaaagcacggatcaaagatgctatctgcggaaaactgggcatggcgcatgggggagaatatcgagtaagagagctgatcaagagggttctcatccaagtagatggcaatctgcaaattcagatgaatgatccggaatatcccaaattactgccgaattaagtctactcatacagcggattgtctggtataatatccctacaagcagtaggtatctaataaataaaaggagaagctgggatggcgcagacaaaggtcgatttaatggcgtatggaatagacagcgtatctgcagaaaaaatattaaaaaaatacacaatacaacaattaaaaaaacagactatggagacgttgctttctttggggttatctaaggaagtagcggagcgattgctgcattcaacacgcccccctatccctcaaaaaatagcagaagaagtactgctcaaatcggcctttacatgctgtatttgccgtcagtctgatttgcctgtcgtgatacatcatcttgagagatgggaacaatcacattcacatgctccggataaccttgctgtgttatgcttaaatcatcacggggaggcccattcctatcatgagaactcccggaacctgacagctcagatcataaggaaagccagagatcaatggtatgcctgtattgaaaaccaaaatattgaagcggagctggccctggatacggtaaggagatattgtggacggtgggactatttcaatctgagctatatttttggcttcattaatgatcgcaaaatatctttcaacagcaggtttaagagcgacttgattgcaaaaggacttattacggagaacggaacgatatgttcagataaactgacaaaaaacgacgcttactggctgaatttttttgatgggctatacttaaaagggtatattgaagaattgcttaacattataatcggccatatgccggttcggtatattagagattctttatatatgcgagatcgagtcatgcctggtgaattactgctggtggatggaagattttattttaaaaggctaaataaatgtacaaaaggaattggtcagacacgcagtgtaaggggcacggtaaatcgcataaggtttacaggggaatttgatgcatggtattgtaattcttcttcatcacaccattctcatttgacaggaaataaacatgcgacattgctgtgtttggtacgcaatgtggaaagggcggatgcttctgatctcgttgactgtacggttattggattggggcttaatttgacccaaccggatttaatggcgcagttaatggggaatgagagaggtttttcggtctcagactttaaatctcaagctgtgtgtgagcgagagttggattcaattgccgatatacagcgcggtcaaagggaaaagaaatactatatatccgctcccgacgtctgcgatatttgcaagataactttccaaaatcaaaagtatatgattgatggcgctatgaagcataatggaactggcgcgtgtatgtgccccaagtgcttccggctgcatggtaccggaattgggtggggtatcggacaactttatttgcgtcaaaataatcgctggcttttggtgggtggtttttgcaactacgaggaggatgagagagaagatgaaatggatgaagaaacaatattacagttgatggacagtctctttccgtttgcgcaggaacaatagatatcgattttaacctcccattccaagccaataggtcaaaagaactatatcggcaaaacgcctgtagttaagcggcctgagaggtccttgagaagaaaaaactcaaggacctcaaatttttacgattaacccttttgcagaactctctggagaggtttgaaccgactgctaaaaacaggtgcagctgatctatacagatcagccgcccttgttctgctacaacagaaggatggtgtcaatcaggttttgcgaggcatctgtatggcgggggggggggatagtgaaaatacaaagggcactgcgccagtcggttggcctccaatcgccgggccgctggaattttgtcagcggcgaaacgtttgaatgctgcatagttgtgtttaaaagaagtaaccgcccttctagccaagaagcagcggttactctattataatggtatttggaatcaaatggatatatacccaccctggaggctcctgctaggctgcggttgcttcttggctggcagtttacttgctggaaaccacgggggcattttggcagagaggtgtcagcagttgtgcaggagatagacctgttgcccgactgatgtagtcgagaatttccaggttggtgtgaacctgcgcgcgctcaatttcagcgtagcttgtgacgctgagatcgattcgaaatgccatttcctcttgactgagatgcttatccaagcggtattccaataaattacacgccaaaatgaattttgattcatcgcacttcacagttatttccccctgtcgtatcgtataacagtttatggaaataattggatgaatcatttaatttttgcctcagcaacaaagattgccttggaaaacttgtttaaatgtacatttaaacacacaaaacagggcggcagctgccgccctgaaaatccgatgttttgctcattgcgtttttctgtaaagagggacgcgcatggctgcctgtgtatccttggcacaagccaagagggtgttgcccccaatatgggcggttttggcgtctgcctgtcttacagtagtgtcagcttttaatccgtttggctcagacgaaatttgccgcaacaacttacttttcacaatatcatctccttttccttactgtaacatgcttaccgcagggcttcagggtatggtgtcctcatccgagatatattttacaatatcaaggaacggtcgtttcaaataagcgaaaaggtgcaatagctcttatatacgcaccgcctttctgcccttacacgatgtgaaaagcggtgtgctgtgatgttatccgcatgattatgatagcatagcccaagcctaaaatatagagtaaaacttcatacgccgtggatgtaccgcaatcataggcaaaattggcgcgcacgaagattttacccatgtgagctgtcccggcttgcgcgctttgatctcgcaccgtgccgccaaaggcggcacatggccgttttgctatgcttatgcatagaaaataagtgcttcacatctattttttgcgtatctcaacgccgtgaggaaatgggtgcaggcaaatgaaaatcccccggcttttgccgggggatcgacttatacaagttcagtgccgtccctgtacagggcctttacggccggatagatttttctgaatatctgatattttttttcatacttacaaaccaaatccgcctgcggctccacagtatcaatgacctttacaatacggctggcagccgtctccacatccggatacgctccacagccgactgccgccaggatggccgcccccaaggcagggccttcctcgctttcaacaatctccaatcgcagattcattatattggcaatcattttgcgccacagcttgcttttagcgcctcctccgcagatccggctgctggtgatggtatttccaagctgccgggcaatctccagtgaatcgcgcagggcaaacgcaaccccttccagaactgcctgcgtcatgtcctttctggtcgtatccatcgacatccccataaataaagcccgtacatgcggatcattgtgcggggaacgctctcccataagatagggaagataaaagacggcgttttcccccagccttgtaatgcccgcctgttcctctgcaaaatcttttgtgcgcagtatttcctcggaccaccatttgttgcaggacgccgcgctgagcatgcagcccatcaaatgatagtggccgtccgcgtggccgaaggaatgcagggcgttgttttggtccacgccaaaatttttgctggaaacaaacagcgtaccggatgttcccaaggaaagattgcacatgccatctcccacggtgcctgttcccacagccgccgccgcattgtctccggctccggcgattactttaacctgagatgacagccccaattcagcagccaaagtctttttcaaagtgcccacaacctcatagctttcgtacactctgggcagcatacgttctgtaatttcacagatccccagcatgggcgcggaccaacgcctgtttttgacatccagcaggagcattcccgatgcatccgaaacgtcggtgcagaaggacccgctgattcgataggccagataatcctttggtagcataattttggagatcctggagaaattctccggctcatgctttttcatccacagaatttttggcgctgtaaagccggcgaaggcgatattggccgtatatttggaaagattttccctcccgattgtatcattgagatattccgtttccattgccgatctgccgtcattccacaaaattgcaggacgtatcacccgatcctgttcgtccagcgcaacaaggccgtgcatctgaccgccgaagctgataccctccacctgtgttctgtcgcagccctcaagcagctcccggacgccctcaacaaattttgcataccagtcctccggattttgttccgaccagcctggatgcgggaaaaacagggggtattcctttgaaacgatgtttttaatctgtcccgcctcgtccatcagcaagagcttgacagcggaggtgcccagatctgtgccgatatataacatacagcctcctattggaccttaatcaccgctttgaccaggtctgtcttgttgttgatcgcttcgccaaaggcctcctggatatgctcaagatcaaactcatgggttacgatgcgcttgatatcgatggcgccgctcgccactgcagcaatcgccttgggatagatgttccggtaacggaatacagattttatagtcgcttccttgtccatgatctgtgcgaagttgtagttgatttcttcctgcgcagcgatgcctaccagcgtgatcgtgccgcctctgcgcacaagaaatggagtctgggcgatggttgcggccgagccggctgtttcgaacaccacatcggcgcccctgccgttggtcaggcggcggacttcctccaacagatcagtttttccgctgttgattaccgcggcagctccaagctcccttgctttctccaggcgggcgtctaccaggtcggcgacgattatctgaccggcgccgtgcgctttgcaggccagcagcgtcacaaggccgatacagcccgcgccgaggatcaccgccacatctcccgttccgacttctccctgattggccgcatagaaaccaacagacagcggttcgatcagacagccctccagagtggacatgttttccggcagtttaaaacacatattctccggaaaagcgatgtactgctcatagcatccctggacgggcggcgttgccaggaatacaacgtccgggcacagattgtagcggccgctcttgcagaattcacatgtgccgcaggtaattcccggctcaagggctacacggtcgccggcttttaaatttgtaacgtcctcccccactgcgacgacggttccggcgcactcgtggccgagcatgtaatcgtcggtcagagggccggagagtccggtcccttgcgcggcctggcgggacgacggcgttataatggatggcgcgcgcttttctcagcaaaaaagcgccgcctgaatccaattggattcaggcggcagtgtggtgggaaatttggagttgtttgaaatacaccagcccgcggctatttaaatatccttattcatgacgctgtcgagagtcttgctgaggagaatatagcacacgaatgtgaccaccatgctgacaatagcgggaaccagaaaattatactgcagggcgatgtaaccgaccccggttccaatcacccaagtgatcatagccacccagttgatgggctttttctctttgctcctgccgacaaaatagtgctcggcaatgatcatgcccgggatgggcggcagcagcacagacagggtctgcacgacaggcagcaaatacttggtggcgccgacagcggcgaaaatggcggccgctgtcgcgataccgatggccagccaggcatgctttatcttaccctccaacttggtgtccttcatgacgttttggagcgccagaccggcgctgtaaatattgttgtcctgtgtggtccagacacagaagatcgcgcagataaagacaagcacacccagaccgagagcggctgtcgcgggaacaaagtcgctctgcttggtggcctgcgcggtcatgatgccgatgacctcaaggccgaacaggccgatggcgacggcgatgggagcgccgacagagacatgcttggggctttttgcatagcggcatacgtcgggggagacgatacagccgaagatccaagcgccaacaaaggaggtggagccggcggcaaagctgatctgcaaatcagagggcggcgtgtaagcaaagacgctcgcatagccggccttggtgccgatggcgatcgcgcaggcgatggtaaggacaatggcgcagggcacgccgagccagcttacaatttccaggccgttgacaccgcggatcgcggactgtgcccacagcgcgaccacaatgatggcggtgatgccgaccggaatgggccaccagctaaaagtggagccgatcagcttggcaaaggtgtcggcattgaccgcgatccagttgacggcggagacggcaagcaggaaggaaagaatggctgaacttctgccgcccatggattttcgggccagaacagaggttgtaagccctgtcctgcaggagatgattcccagaagtgttgcaactacaatcagcatcagattgcccaggccgcaagccaaaatggcttgctgaaagggcattttgaagccgacggtcgcaccggtgacgaagttggacagagagatggtatagccggtcagaatgaccagaatgctgcccagactttttcgggcgctgtcggggacttcttcaaatgcaaattcaatttcgctgctggagctttttttatctgtggatttattcataaaccgaacctccttttgtctttcacactgtgatgtcagaaaaaacgcatgcgcacaagagcttcagcggcgcagccggtgcgattggagccggacccatagcaaaaaaaccgaaaacggagcagcgatatcgctgctcaagaaacgggcatgcccgtttcttgaaaatctccgtcggcgtctttgggcgctccggccgcagaacatgcgattggaaagccgcatacatccattgcattccaaagcaggaagattgcaataaaattattttatttttggctattgattcatgcataaatcacagtgataaaagtttaacacttattagtcaaagtgtctaatatttgttttttatcgtttataatcaaatggatattaaaaaaatatatatcagtgcggatatttttttatcataggcattccaaacgcaaaagatagaatgattgaggcgggttgcgtggattcgggctgcaaactgtgagaaaaactggacgtcattacgatgccggagcaccttctggcggcggtcgtctgtatataatcagatattgacaataaatatagtaagcgccttcccgaaccggcgctgtgtgattcttttttggggcttttggcgctgtatcattttcgcgtatgggctgctcttgtaatcacagggggaatatgctatcatggatgagacatactttatctgtaaaaaagcatggctgcatcggtataaaacggatgagccggcgtgacgctgaacccggcctgcggctgcggcccggcgttgttttttttcccgtgccgcttttgcggcggacagcaatctgcggggaggcgttcttatgcaggacggttttatcaaagtggcggtcgcgactccggaaatccgtgtggcggactgcgttttcaatacggcggcggctatggggatggcgcgccgcgccgcgcagtgcggcgcgcgccttctggtgctgccggaattatgcctgacgggctatacatgcggcgatctttttctgcgtgaaacgctgattgaaggcgcgcgcgccgctctggcgtcgctgtgcgcgcagacgcgcgcgctgccggtgctgattgtcgccggactgccggtcgtatccggtgcaaagctctataactgtgcggcggtcgtctaccaggggcgtgtactgggcattgtgccaaagacgcacctgcccaattatggcgagttttacgaacggcggtggtttgtgcccgcgccggacggttcctgcggttttgtacgcggctatggagagggtgaggtgccgttcggacggatgctgtttcaatgcgaggagcttggagaattttgttttgccgtcgagctttgcgaggatttgtgggcgccggtggcgccttccgcggcgtatgcggccgcgggcgcgactgtgatcgccaatctgtcagcctcggtcgagacggtcggcaaggatgattaccgccgcgcgctcgtcaccggacagtcaggaaggcttgtgtgcggatatctgtatgcgaatgcgggcgagggtgaatcgacgaccgatcttgtgttttctggacacagcatgatcgcggaaaacggctcgatgcttgcgcagacaggccggtttgaacagacgatggcggtcagcgagttcgatgtgcagcgcctggcgtttgagcgccgccgactgaccactttcccggccggggatgcgcaatcgtttttgacaatcccgttttccatgccgctcaccgaaacaaagctgacgcggccggttccggcattgccgttcgtaccgccaaaagggcctggccgcgaccagtgctgcgccggcattttgcaggtgcaggcccatgggctgaaaaagcgcatcgatcataccggggcgaaaacagcggtcgtcggcatctcgggcgggctggattcggcgcttgcgctgcttgtctgcgtgcgggcaatggagctgctcggccgtccgcgcaccgatgtgcacgcggtgacaatgccgtgcttcggcacaacggcgcgtacccgcggcaacgcgcagatcatctgcgaacggctcggcgtcacattttcgtgcgtcgacatcactgcgtccgtgcggcgtcatttcgccgatatcgggcacgacgaggctgtgcgcgatgtgacgtttgaaaacgcgcaggcccgcgagcgcacgcaggtattgatggatatcgccaatgagacgggcggactggtcgtcggtacgggcgacctttcggagcttgcgctcggatgggcgacctataacggagatcagatgtcgatgtacggcgtcaacgcgtcagtgccgaaaacgctggtgcgccatctggttgcatatgaggcggagcgcgcctgcgacgatgcgctgcgcgccgcgctgtgcgatatcctcgacacacccgtcagccctgagctgctgccgccggacgacggcgcgatcgcacagaaaacagaggatctggtcggtccgtatgagctgcatgatttcttcctctaccatgtgctgaggtggggcttttcaccgcataagacgctgcgtctggcgctttatgcgttcggtcaggcgtacccgcgcgaaaccattctttactggatgcgcaccttttacaggcgctttttcgcacagcagttcaaacgctcttgtatgccggacggaccgaagatcggttcagtgtctctgtcgccgcgcggcgactggcgtatgccgagcgatgcgtcggccgcgctgtggctttctgaggtggaaaagctttgacggacaaaaccaggcggcggtttaaaaaccgccgcctggttttgttcagatacggcgtctgtcgattgcgtcaggaatgcgcgggtgttataatgtaaggcacagaccaaaatcaaatgtaaagcaaaggttggagatggcatggagctgggcgtcagactggaacagaatcagatattggcgccgcgtatggagcaatctgtgcggattttgcagatggacagcgtacagcttggggaatacctcaaggagctggcgcttgaaaatccggtcgcggaggtggaaccgccgccacagcgcgagcaaaaggaaaagctggcgcagcgaaagctggaatggctggaaaatcagacgcgccgcgaacaggagaatatgggatattatgacgacgacggcgacctgacgccggagcagaacacacccgcgccgcaggatgaaagtctgacggaccacctgttggcgcaggtggaatcagcagccgtgccaagggcgctggccgcggcggcccggtatgtgatcggctgtctcgacgataacggctatctaaaagcagatcccgaacagatgcgtgccaaagccggggcgtgtgacgcgctgctcgaacgggcaatcgcgctggtacagagctttgacccgccgggcgttggcgcgcgcgatctggcggaatgcctctgcttgcagataccagcttccgatgcgctcgcgcgccggctggcgcgggactttttgcctgagatcgccaaaaaacgtgtgggcgtcctggcggcgaaaaccggcgcgtctgccggggaggtggaagcggctgtcgcgcgcatccgccggcttaatccgaagcccggcgcgctttatggagcgcatgtcgttgcgcattacatcacgcccgatattgtggtcacaagcttcggggaccattacaatgtgatgctgtgcgaatttgcctatccgcaggtgcgcctttcagacagctatctgcaaatagcgcgcgagacggctgatcctgaggttatcaaatacatcggcgaaaagatcgatcaagtcaattgggtgatcaaatgcattgaaaaccgaaataggacgcttgtggaagtggcgcgggcgatcgtgcggcagcaggagcgtttttttcgctatgggccgcagcatctcggcgtcctgcgcatgcgtgagattgccgggctggtcggcctgcatgaatcgacggtcagccgtgctgtgcgcggaaagtatcttcaatgcgcgcacggcgtctatccgttgcgttatttctttgtcaaaggtccggagcacggcggggcggtcagctccgaggcagttaaatataaactgcgcgcgctcattgatgctgaggaccgggcgcatccgctcagcgaccgtgcgctctgtgagcttctggcggccgacggcgtcagcatatcgcgccgcaccgtcgcgaaataccgtggggagatgggtgtgcccggcgcgtccggcagggtccgcggctgaaagaccaggcaggtacatatgtcccggttcgcatcgggaaacggttgttattgacataagcgcgcgaaaaaagcgcagtgaaaggggacggtatcatgagccgaatcaatctgaaaatcagaagtgtgctttgcgcggcgctctgctgcgcggcggttttggcgggctgtgcgccgcagggggagaagcaggccgcgtcctcctttggcacggtgtccgcggcggcagttgacacggcctcgccggccgcgtccggtgcggttgatctgaccgattacgatgcgctgaccgatacatatctgcaccggccgttttattcgggcgtgaccgcgcagagctgggatacgccccgggagattgacggcggggcgctgatcgatttttatggcgtctattggacacaggagcatcccggtgaacagagcggcggctttttcccggcggctgaggtggaggcgtatgtgcgccaatttttcaccgcggacccgacggagacgatgcgtgcgcacgcccggtatgacgcgcagcgggacgcctacgaattcacagggcttggcggcggcgcgtccgggcgtgtcgtgggcgcggctctggacggcgatatgctgacgcttgattacgcggccttcagcgcggcggacgatacgactgtaatgtgggaagggacgctgtcaatcgtgcttaaggaggacgggagctttcagtatgcgtcgaatatacgttccccatcatccggtacggggaatcagggcgcggcggcctgaacgaatgcccatccgcctgatttgagcggctgccgggacagggcgcgtatgatccctatattttagatcaggcggcttcgccgagagggaggtggcttcatgccgcacatcgggatgcgtattatcaaatcggctgcggctgtctttctgtgctttatgatcgacctgctgcgcggcggcgcgggcgtgccgttttactcggcgatcgctgccgtcctgtgcatgcagccatatgtttcaaacagcatcaaggttgcgctcaaccgcgtcgtgggtacgctgatcggcgggtgcgcgggcatggcgctgctgctgtttgaacgcgcgtttctgccgcgggattggccggttgtgcaatacttgcttgtgtcgctcatggtgattgtactgatctatatcacggtgctgcttcgggaaacgagcgcctcttacatcacctgcgtggtctttatgagcgttgcggtttcgcacggcatggacgtcaatccgtatctgtttgcattcaaccgcattcttgacaccctgatcggcatcggcgtatcgcttgcggtcaacagcgcgcacctgccgctgccgcgccgccgggagatcctgtttgcgtgcgcgctcgacggcgggctgcttggaaaaagcgggcggatgaccgcgttcacacgcatccgtctgacccagcttgccgagcgcggcgcgaatatcgccgttgtgacggaccggacgccgtcgtcgtttttgccgctgcttgacggcgcgcagcttcgcctgccggtcgtgtgtctcgacggggcggctttgtacgatatcgacagcgcgcgttattccgacctgcgcgcaatgccggaggaggctgcgcgcgctgtgaccgccgcgtttgaaaaagccgggcatgggtgctttatttacagcgttgtgcgcgatatgatgcacgtctattatggaaaattttcaaatcccgccgaggaggcgctttatgagcagctctatgccagcccgcacgaggcgtatgtttacggaccgctgccggccggctgcgacgcgctgatgattgccgcgcttgagacggacgaagccgccggggcgctgcgcgccgccattgaggcgctgccgcaagcggaatatctgcgcatccgcgcggttttggcgcggggatatccgggatatacgcggctggaaattttaagcgcgccggccaggccgcgccgtgcgcttgaaacgctgcgggcgcgctgcggcgctgcgtctgtgcaggcggtcgtgcagccggccggcgagaacggcgacgcgcttgtacgcgcgctggcgcgcgcgttccaccggcgcgcgccgcggtgaggcagcgcatcaaaaagggcgtgggagccatggctcccacgcccttttttcgattcatggttcgcagaccttgtgcggattgaggatgcccttggggtcgaaggcgcgtttgactgcgcgcatcagggcgagtatgcgcggcggcagagactcgctcagataagcgcgcttggcgtagccgatgccgtgctcgccggatacctgcccgcaaagctgcctgccgcgttcatacagcttttccatcgcaagcgcgagcttctcctcccatacgccgtccggcaggccgtcgcgcagaatatacgcgtgcagattgccgtcgcccgcatggccgaagctcttgatacgcacgccaagctcggcctgaagcccgtgcgtatactccaccagagcgtccacccggcagcgcggcacaacgatgtccacctcgtccatacaggtcgtcgagcctttgatcgcttccagaaacgcgccgcgcgccttccagatcgattcgtcgcgttcctcggtgtcggagatcagcacgtcgagcgcgccctgttccaaacagatctgcgccacgccttcatacagccgctctagctcctccgccgagctgccgtcaaacttcagaagcaggtatgcgtccgcgctgtggtcgggaaactttttgccaaggtattcctccgcatccgcaatgacctcccgctccataaattctatcgccgtcggggcggccttcgaacggataatcagcggaacggtgcggattgcctgtccaagcgtcgggaacggaatgagcaggctgaccgttttctgcggcaggggcagcaggcgcagcaccgcttttgtcacaatgccgagcgtgccctccgagccgacgatcaaatccatgagatcgtagcccgagctgtttttgacaatctttccgcccagctccacgatctccccgtcgggcagtacaacctccagcgcgcgcacataatcgcgtgtgacgccgtatttgacggcgcgcataccgccggcgttcgtgctgatgttcccgccgatcgtggctgatttttcgccagggtccggcgggtaaaaaaatccgcgctcctccacataggccgccagatccatcagcagcacgcccggctcgacggtcagggtgagattgtcttcgtcaagctcgagtacctggttcatcaggctcaggtcgagcaggataccgcctgcgaccgcgacggccgcgccgaccagtcccgtacccgcgccgcgcggcgtcaccggaatggcgtgttcgttggcgtaccgcatgaccgccgaaacctctgcgacgttttttgcgcggaacaccgcctgcggccagccggctgtgccgctcaattcatcgtggctgtattcctcgctgatctcatcgccggccagcacccggtcggggtcctgtgcaagctgccgcaggaatgtaagatcgtgttccgtcagacgttcgcgcataccgccgcctcctttcgttcccggagctggccgagcagatgcgggacaatctcgtacaaatctcctaccagtccataatgcgccacccggaaaatcggcgccttttcgtcgcggttgatcgcgacaatcgtctccgcatggtccatgccggccacaaactggatagcccccgatacgccgcaggtgatgatcagcttgggacgcacggtgcgcccggaaaggccgacctgccgcttggcgtcgatccagccggcttccgccatcgggcgcgtacaggcgagctggccgccaagcagcgacgccagctcctcaagcatggccaggtcctcctccttcttgacgccgcgtcccgccacaacgagcacatcggccgattcaatgtatttttcctccggcttcggcgcggcttcgagcgcctgcacgccgcccttcaggcgggttggatcgacgtggaggctgacgatctgcccgctgctgtgcggcgaccgttccggcgcgttcatcaccttataacgcactgtagccatctgtggacgatggttcggggtgacgatctccgccatgatattgccgccgaaagccgggcggatctgtacaagatcggtgttttcattcatctccagcactgtgcagtcggctgtaagccccgttttcagccgcgcggccacgcgcggggcaagctgccggccgacagccgtcgcgccgaccaggatcgccgcaggacgcgtctgtgcgataaatgcttcaaagacggcggcatacggttcaatggaaaaatggcgcagcgcggggtcgtcgcagacatagacctcgtccgcgccgtagtgaagcagctcgtgggcggcttggctgacgccgccgcccatcaggaggacgcggaccggctgccggatgacggcggccagttcgcgcgccttgccgatcagctcgaatgtcaccggatgcagcacgccttcctcatggtcggcataaacggcgacgccgctccactgtgatttgtccacggcgggcgccgctgtatcctcgacgtattccgccgcgccgggcggcccttttctgacgcacaggcggcacattttgcaggcggcgctgacctgtaccgtaccgccccgctcctcaagcgccccgaatgggcagaggcggataaaggcggctgtgtcgccgattttttcaggatggatcaccagttttgccacaaggcgcaccccctctcatacaaattttttctgccgcagcatcgtgtacaggcgtgcgccgagcgtctggccggaaccgcgccagatttcccggcgcacgtcgctttccggcgggaaaatccgccgcacctgtgtgggcgaaccgttcaggccgtaatgccgttcatcccggtcgtccatatcgtcgagcgtcaggaccgtgacgggccgttcgcggctggcgcacagcttgacataggagggcaggcgcggctggcagatgtccttgtcgaccgacagcaggcacggaaactgcacgcgtgtagtttcaaggctttgcggcagatccgcctccacgacgacggcgcctttctccgcgcggacaatccgccggacgttggccacgcttgggatgccgagccattcggcgatctccgggccgacctgggcggtatcgccgtcggtcgtctgcttaccgcagatcagaaggtcgaagcggcccgcccggcgcacgccctgcgcgagcgtatagcttgtggcgagcacgtccgcaccgccgaaccgccggtcggagagcagcacgccggcgtctgcgcccattgcgaacgcctcgcggatgaccgcctgcgcctgcggcggccccatgctgaggaccgtcacgctgccgccgtgttcctcccgcaggcgcagcgccgtttcaagcgcgtacaggtcgtatgggttcatcttcgattccacgccggcgcgcttgagcacgcctgtctgcgggtccacctccaccttgcttgacgccgggacctgcttgatgcataccagtatgttcatacgtccgtttccccctttgcgccgtcggatacgatagtgttttcaagccgtccgatcccgtcgatttccacggaaacggtatcgccgggctgcatgggtccgatgcccagggtggtgccggtcaggatcacgtcgcccggcaggagcgtcataaccgccgacagccagcttacgatccagagcggcttaaagagcaggtgccgcgtattcgagttttgcacggtacggccgttgaggatggtgcggatcggcaggccggacgggtcggcctcggtatcgacgcaaggcccgagcggcagaaacgtatcaaagccctttgcaaccgaccactggccgtccgagggctgcaaatcgcgggcggtcacgtcgttggcgcaggtatagccgaggatatggctggccgcctcgtgttccgggacgtttttggcgcgccgcccgatgacgattgcaagctcgccctcgtagtccacgcgctttgactgcgccggataaacgatccggtcgccaggcccgatgaccgccgtggagggcttgataaagacgacgggcgatgtggggaccttttcgtgcgattcaatgatgtgatccatataattaagcccgatacagaccgctttgctcggtctgacgggtgcgagcaggcgcacatcggcgcgcgcggcacatttgtccgacggtgtaaagccagtgtccaaagcgccgtcaagcaggcggatggtatccgcctgcaagtcgccgtactgctcgcgcccgttataaagaaatctgacaagcttcatggcgtttgccgcccctttcatatgccagccggcggcgcgcgtcagccgcccagataggcttttttgatatcggggctgtcgagcagctcccggctgtcgccgctgttgacgatgcggcccacctcgagcacgtaggtgcgcgaggagatcgacatggccataaacgcattctgttcaacaatgacgacaggcgttttgcgtgtgcggttgattttgacgatggcgtcgaacatctcgtccacgatgacaggggcaagcccgagcgacggctcgtcaaacatgatcagcttcggatcgctcatcatgccgcgcccaatggcgagcatctgctgttcgccgcccgagagggtgcccgcctgctggcgggcgcgctcctttaagcgcgggaacagctcgtatacctcggcgatgtgctcgtcgagctgcgcctttgtatactttttgcaaaacgcgcccatctccagattttcaagcacgctcatctgcggaaacacctcgcgcccctcagggatatagacgatgccgcgtccgacgatcagatgcgctttcaggtcgctgatctgctcgccgttgtaggtgactgcgccgcgtgcggggcggttgatgcccataatcgttttcatgagggttgtcttgcccgcgccgttggcgccgatgattgagacgatctcatcttcgtgcacctcaatggagacgtcgaacagggcctggacgtttccgtaaaacacgtcgattccatgtactttcagcatagccatagactaaccctccaccggcttgtatttgtcgccgagataagcgcggatcacctcgtcgttgttctgaatttcatagggggtcccttccgcgatctttgcgccgaagttgagcacagtgatcttggtgctgatattcataacgacgtccatgttatgctcgatcaaaaagagatcgatcccgcgctcgtgtgtttttaacaggatgtcgacaaattcgcgccgctcggaagggttcagccctgcggccggctcgtcgaggatgagcagggccggcttgagcatgagcgcgcggccaagctcggtcatcttctgcttgccgtaggcgaggtttttgaccttttcatggcgcaggtcggcaaggccgatctcctcgagcacctgttcggcgcgttcggtcagcagcttttcctctcgtttttcgccgggcaggtcgacgagaaaccgcacaagcccgatctttgtcatctggtgcgcgccgatcatcaggttttccaatacgctcatggacccgaacagcttgaggttctggaatgtgcgccccacgccaagacgggcgatgcggtagacagggctgccgcttgttttgacgccgcggtaaaagatttcgccctcgctgacaggcagcacgcccgtgatcatattgaccgtcgtcgtcttgccggagccgttcgggccgatcagcgaatggatgcagttttccggcatttcaagcgacaggtcgttcacggcgatcaggccggaaaagcgttttgtgacatgctccattttcaggacaggttccatcatgcgcgcctcccgctcttttgttttttcggcatccagaaccggccgagattcttttcaccgccaaacagggatacaagcccgttgggcaggaagatcgcgaataaaagcgcgatgatgctgaaatacagccagtagttcgtgcccagaaagcgcaggcattccggcagcagcgtgatcatcgccgtgcccaggatgttgcccggcaccgaaccgatgccgccgatcatcatcatgatcagatagttggccgacagatcagttgtaaaggtcgtcgggttgagatagcccatcaggtaggcgtacattgcgccgccgaggcatccgaacacggtggccagcgtgaaggcctgaattttgattttggcgatgtcgatgccgcacgcttcgaccgcctccacattgtcgcggatggccttgaacacgcgtccccatttggaatggacaatgcgccacgcggtgaacgcgagcagcacgacggcggccaggtacaggtagtagaccttgcgcgaggtatccagcgcgtagccgaacaggctgatatgcgggatgccctgcacgcccatggtgccgccggtcagctcgacccagttggtcaggatcaggcgcacgatctctgaaaagccgatcgtcgtcagcgacagatagacgcccttgagccgcaggctcggatagccgagcatccatccgatggccagccccatgacgatcgccagcagaaagccgatccagggcgatacgcccaggcgcgtgctgaacagcgccgccgtataagcgccaagccccatgatgccggcggtgccaaggttcatctggccggtcagcccggtgatgaaattgagtcccatgacaatgacgatattgacaagcgtctgactgagcaggatatgtacataggcgttgtcatacgaaagcgggaatacgacgaggaaaatcagcagcaggcagagcgccgcccgtttgatccgtttcatagcgggcctcctttactgtctgtgtccgagcaggccggacggttttacaagcagaaatacgatcaacagcacaaacgccacgcagtccttatacagggtcgggatgacaagggtgctcagattttcaaggataccgatcagaatcccgcccgcgatcgcgccgggcagatagccgaagccgccgatgacgccggctgcaaagcccttgagtccgatcatattggcgatggtcagatcgatggtgaacagcgggataaccaggatgccgatggcggagcagatgaccgcgctgagggcgatcgtcagattgatgttggcggtcacattgatccccatgagcgtggcggctgttttgttctgctggacgcagcgcatcgccttgcccattttcgttgttttaaaaaagatctgcaaagcggtcacaatgaccgcggagacaaggatgatagcgatattggcccgcggaatcacgatgctgccgatcttgacgatccccttgagaaagccgggaactgtaaagggcgtcgctccccagatgacacgggccagctcggtcaggatgcgtccgaggataaccgtaccgatgaccgcgaacacgggggaggccatgttgcgcagcgggttgaaaatgccggtggcgaccagaacgccgaacaggaacatggtggcgacggttgcgatgatcgcgatggccggcggcgcgcccatgcgcaggacgaactgtccggcgaacacataggcgccgagcataatcagcttatcgtggctgaagttgagcaggccggttgcattgaagatgatggtgtattcgattgacacgagcgcgtagataaagccgagcgccagcccgctgacaatcaactggacaatgatttcggctgtcaattctttcaccccttatgatccgctgttttgccagcggcgcgcgcaaaacagccggttatagttggatggccccgccggactgggtccggcggggccggtttttttgtgctgtgcggttacgccgcgagatcgacgtattcgaccatcgtcgggaccttatcgcggatctgtgcgatgacgcagccgtgcagcaggttgccgttttcgtcgcatttgtagctgccttcaggcaggaccagcccatcggttgcggccagcgcgtcgcgcacagcctgcggatcggccgagccagcgcgctcaatcgcatcggccagcacataggtggcgctgtaataggtagctgcgtaaagctcgggggcatagccgtacttgtcggtaaactttttggtaaactcggcggtcacagcttcatcgctggtcgatacaaaatcggtgacggaataccagccctcgacatactcaggttccagcaggttgagcacctgatccataacgacgcccgccgatgcgatcaccgggacgtcgacgccaagctcatagagctgacgggcggtcagggcgacctctgcgtcgtcggtccaggagatgatgcagtcgacgccctcgcctttgagctgcatgatttggccggtgagatccttgtcgccggcattgtggccgaccgctacatacggcacgcccgcttcctcaaggtaggcaatgatcacatcgcgtccgccagtaccgaaatcgttattgttaaaggaaatgcctatctttttcgcgccgagcgtctcgatggcgtatttggccgccacctgtccgttgattgtatccgccgggcggcagcggaacatgtagggattttgagcctcctcaagcttggggcttgtgccgccggttaaaaatgggacgccggcattgcggtaaagctcattggtcgccatcgcgtttccgcttgtatgcggtccgatgacggccgcgacgtcctgcgtcaagatctttgtgacgacgttgaccgctgtggtctgggtgttctggtcgtcctcaatcgtatagacgagctttttgccaagcacaccgccgtttgcgttgatttcctccaatgccaggtcgatgccttcacgggtacgctggcccgccagtgggaagttgccggtcagtgcgcagctcaggccgaacaggatttcaccgtcggtcgcggccgtcccatccgcgggcgcggcggaggcgctgctctggggtgcggacgcggcggtcccctgactggaggcggcgggctgcgaagcgccgccgcagccggcaaacagtgtggtggacatcgctgccgcaagcaggattgcgagatgctttttcatttcgattcctcccatttttcagttagagccagatgcttatgcagatgcagggtgagcggatcatccttaagagaaccggcgcggcgtccgtcccgcgatttgcggcgcggcctgtttttacgctgtacccgccccgctgttcgcggcgcagccggctaaagttttttgccgaggctttttttcaaaaaagccggagcgcagccggctaaagttttttggcatacctttttttcaaaaaaggtatgcgggagatcaggagagcttgccggcctgcctgagcacgtcggtgaggacagccttttccgcttcggtgatgggggcgagcgggctgcgggccgggccgaccggaataccggttacaagctcgatggccgggcgcatgatcgagttgggcaggatgcgtccgttctggccgcagctcttgcagaaacggtaaagcgggatgaacagctcgcgggcgcgggcgttgtcgccggcggcgaaggcgtccataatcgcgcggatttcatggccgaagatgtgcgcgccgccgcttacgatgcccatggcaccctgaacgatggtcggcagaagcatgatgtcgtcgccgttgaagataacgaattcgggattggtgtcctcggtggccagaaaataatccgtgacctgggtcggattgacgccggcctcgtccttgatgccgatgatgttcgggattttggacagctcatggacggtttgggcctcaatgttgatgccgacaaagatgggaatgttgtaaagcaggatgttgacgttaacgctttcggcgatctgcttgtaatggttgtaaacgccctgctgcgtcggcttgttatagaagggacagacgatcatgcaaagatcgatgccgagctccgcagcctttttggtgagcgcggccgtttcctttgtagaggcgcagcctgtgccggcaatgactggcttgcggccggcgctgacacggacggctgtttccatcaggcgcacgcgctcgtcaaaggtgagcaggcttgcttcgccggtcgtaccggtgacaatcagcgaatcgcaaagatcgtttttgatcagatattcaatcagatcgccatagaccttgtagtcgatttcctcatccttgccgaagggcgtgaccagcggcaaaagaatgcggccgtattttgcggtgaactctttccttgtcatgctgtgttcctccagatcataaattgtaatatttatcaggctgtaatgttgtctgatatcgtgtctaaaagtatagacgggatgcttgtggttgtcaacatgtattttgaaactttgtataaaataataaaaatatatagtaaaattttgttgtattacaaaaaacaaaagcttgacaagtctgaaaaagggctgttataatcaattaagatgtcagacaatcttataataattttattaatcaattaaggaggttcgcatgatcattgacgcgcactgccatcttggcagggatgtggtttacgattttgaggtgacagaatcgcggctgctcggcacaatggcagaaaacggaatcggcggcgcgatcgtccagccctgcattgcacggccctatctggaggatacgcgcgccgcacacgaccggattgccgcgctctgccaggcacatcccggacggatatgggggatggcttcgatcaatccgcattttaggccggacgattaccgcgccgagctgcggcgctgtgtaaaagagcttggttttgtcggcgtcaagctgacgcccaacggccatgcggtcgatctgctgtcgcgtgacgcccgagaggtctttgacgcggcgcgggagctgtccatccctgtgatggtgcacaccggcatgggcgtcccgttcgcagacccggttcgcctgacgccgctcgcgcgcgattattccgatgtccgcatcgtgatcgcacatgccggttccgactttttttcggtacaggcaatgctgttggcgcaggcgtttgacaatgtctggctggagccgagcggcgtcggcatagaaaatatcgagcagtttttgcaggcgctgccgcctgacaagctgatgttttccaccgatgtgcctgcgcaggcggccggggagctgttcaaataccgtcaggcggcgcgggatccggccgcgctcgagcaaattttttcacacacagcgatagaggtctttcgattaaaccccgaatccatgtcgtaaaggagctgtattgaaatgagagatggagcacagatcattcttggagcaggaagatatatccaaacgccgggggctgccgcgctgaccgggcgggaggcgaaattttttgcggaccgggctattgtggcggcgggcgcgaccgcgtggcagatcgccgggcaacaggtggaagaaagcctgcgtgcaaacggcgtggactttctgtttcatccgttttccggcttttgcagcgagacgacggtcggcgcgattgtgcgcgacgccgagtcgttcggcgcgcggctgatcatcggtgtgggcggcggaaagtgcatggacacggtcaagctggcggccgaccgtctcggcgtccgcgtcatcaccgtgcccacgtcggcggctacctgcgcgtgttatgcgacggtctgtatcaagtacgacgataccgggacgccggactgcaacgaatactgccgccagccggtggccgctgtgctggtcgataccgacctgctggcgcgccggtgcccggcgcgcatgctggccgcaggcgtggcggacgcgatggccaagtatcctgaaatcgatttcagtattcgctttgtcaagggctgggatatcacaatcatgccggtttcggctttgcaggttgccaaatcgaacacagataaatattttgcagacgcggccaacgccgttttacaggttgcggacggcacgcttacgccggttgtcgacgatatcatcttcacgaatcttgcgctgacgggtttgacctcgcaactgtcgagcggcagcaagcagcttgcggtcgcacatggcctttacgacgccgtcagcaagctgtttaaaccgcagcgcgcaaggcttctgcatggtgagatcgtctcgtgcggcattcccgtgcagcttgcggtcaatggatattcagaggagtacatcgaaaagaatgtgcgttttcttgagctgatcggcacgccgacgcagttttcacagctcgggatcgagccgactgaggaaaatctggagcagattctcgctttcatttttgataatgtcgggatcgacgaaccagcgcttcaggaaaaaatccgcaagaactttgcacgcgtcatgaaataggcttttggcttttacataccgaatataaatgaactggcaagccttctatttttaagcaggctcttgatgagaaatgttggaagtgttataatagaagcggatacgtcccgccctgttgtcttgtgatcggacaaagctagtacgagccttgggcaattccatgttgaaagcggtgggccttatgaaaccgatcgaacggatttcaattgtcgatcaggtgatcaacaatttgaaggaatacattgtcgaaggaaacatcgatgtgggcgataaaatgccgacagaaaaggaaatctgcgaaatgtacggcgttggccgttcaacggcgcgcgaggcgtaccggatgatgcaggccatcgacatgatcgacgtgcgccgcggcaagggcgcttatttcaagggctttcctgaggaacgcaccgacgacagctatgtggccaactggttccgcgagcacagccagcggctgaccaacatcatggaggtgcgcatcgccatcgaaacgatgaccacacgtctggcgatccagcgcatgagcgaccggcagcttgaacagcttcgcgtgctgcatgagctgttcgtgcagagtgcaagggcgaaaaactatgtcaagatggcgttttacgatgaggagctgcatcataagattgcggaggcgagcggtaacgagctgctgatcagaatggaaaagatcatcgccgaatgtatcatggattaccgtatgcagacctaccagctgcccgataacgccgtacatgcaattaccacgcacgacgcgctgctcagcgcgtttgaaaagcgcaacgccgaagccggcgtcgcgctgatgaccgaacatctggaaaattccctggaggatatgcaggccatcacgcaggaaaaggattccgggacgccattataaactgtgcttttaaaacacaaaacgccgcgcgatgatttcatcgtgcggcgttttcgcatccatgaccgtttgctgccgtcacggagcgaggcaaaatattagagccgtcgcattgcgggaagcgtagagagaaggtcggtttttacagtgtttacgggcgaatgtgaaaaattataaaaaaatagtgacaaaacatgggcgcggatatataatagaatccgtcttgccctggggcggttcgccgtttaacagcgagccgtttcagagaaacagaatgaaggagagaaaacacatgaaaacaaaatggctgtcactgttggctgcgatgctgctgcttatcgcacttacggcgtgcggcggggcggacatgccgatggaggccacgctggatggctataccatcgtcctcgggcagacaaccgtacaggatcttgccgaccgtgggtacgaggcgcacctggagaagatgccggatttcgcgcgggacggagaaaaatacatttcatttaattacagtctaagcaggggcgcgggcgatcagatttttgcgactgtcagcgtgccgtggagcggaaacacagatattaccgaggaaacaactctttccgcttcagaggggattttgcagaccgtgacgcttaccaaaacagcgacggaaaaggttgaggctgcatataacggcgtaagcgtacaggatttgtcattcgattatgccgcgcaggaatggggcgcgaaggaaaaaaaggacgcgtcgaaaaagacttatacacttcaggcgaagcgggggttggtacagtttcaaagttatctgaccagcgatgaggatttccattccgtttcaatccagctttctgataaagagtttgaaaaaatgcagaagtgaggagcagccgcgtagcgttctgctgatatgacagcggttcgcaccgcgccgccaagctatgcgtccgaccggtaaagccggcgggcgcattgctttttttgatggcgtttttgtcgacgagcgtcgtattatataacgcacgggactgaatattgcgtagatttaaaaataaaagtacattttatggtgcagaagtgttgaatttttttcgtaatatgtttatactgataataaaaaggggaaagttgtttcctaatagaagggccctttatccgccgcgcttacaggaaaaagggtcagggagggaatgagcgcatgaagtccatcaaatcgaaaatcctggtcaatatgctgccggttgtattggccggtgctttgttgatcggggttgtttccgttgttttaaactacaaaggcacctatgccgtgctcgagtccaccgtcggcccgatcgcggaggtcgcgggcaaaacgatcgaggaagatctggaggggtactgggcgaccctgaccgaggccgcgtcgctggacgtctttcacacctcaaagccaagcgacaaggcgctgatcgagcggtcggagggtattgcctcgcgcaatggatttatgtatctgggcaagctcgacgcgcaggggatcggcccgtccgggacaaacaacagcgaccaggattattttaaatggtgcaaggaacgcttgagtccggttatttccaatccgattcatgacggcgcccaagtggtttttctcatggcctctccgattttaacaaacggaaaattcgacggacttgtttatggagcggtggacgcgtcgtttttaacggagattgtaagcggcctgcatatcggcgaaagcggacaggcatacatccttgacgaatacggcgatgtgatcgggcatcccgatccgtcatatgtcgtcgacggcgtcaacatcatcgaccaggccaaaagcgacagaagtgttgcggatatcgcggctatccatgagcggatgatccgtggcgaatccggcttcgatacatataaatttgacggagacagtaaaatcttcggctatgccccaatcgtaggcgaacagggctggagcatcggtattgaggccagcaagtcggaatttatggcgtcgctcaaaacgagcatcatgattacggttctcattgttctggccgttatcattgtcgcagtctttatcgctgtgcggttggcacgttcggttgccaatccgattaaggcctgtatggagcgtttggatctgctttcgacaggtgatctgcacacgccggttccgcagattcattcaaaggatgaaacggccggcctgatgaacggcctggatgtgactgtgacacgcctggccgatgtggtgcgcgacgtttccacgcacttgggcgaaatggcacagggcaattttacaatggaaatgacccgccagtaccggggggattttgtcgctattcagcaatcgatgaagcagatcaacgattccatcaacaatacgctttctcagatcagcatggctgtcgaccaggttgccagcggatccgaccaagtggctgcaagcgcccagtcgctcagccagggtgcgaccgagcaggccagttctgtgcaggaattggctgcgaccattgcggatatctcgaaccatgtgcagcgaaacgctgaaaatgcaaccagcgccaacgagagcgcgcagcgtgccggagacgatatgcagcagagcaatgtcaaaatgcaggatctggtcgccgccatgagcgaaatcaacagcacgtcggatgagatcagcaagatcatcaagaccattgaggatatcgcgttccagacgaatatcctggcgctcaacgcagccgttgaggcggcgcgcgccggcgcggccggcaagggctttgcggttgttgcggacgaggtgcgcaacttggccggcaagagcgccgacgcgtccaagagcacggcggcgctgattgaacgttcgcttcaggcggttcacaacggtatgaaactggtggatgagacagccgattcgctggtgcgcaccatggaaggggtcagcgtttctgtacagatgctcgaccggatcgcggaggcgtcgcgccagcaatccgaatcgatcgaacaggtcagcctgggcatcgatcagatatcctccgtggttcagacaaactccgctacctccgagcagagcgccgcggccagcgaggagctgtccagccaggcggggcttgtcagatcgttggtcggccagttccggttgcgcggcgccgccgcccaagcgccgctggacgagccggcggaggagtctgacagcttgacatttacagattccaaatattgaccggttaaaaagaggctggcatcactggatgccagcctcttttttacaaattacaggccgtagcgggacagaatatgctcatatttttgcagcagtgtgcggcaaacactgtcggccttttcaaagtccatcgcagaccggtaatactcctccagttgatcgtgcagacgcttggcctcggccagcagcttgctggcctgctcgatcatctgcgccgccgctttgcggttgaaggcgatgcgcttgcggtgcgcacgcagttgttcagcgtcggtgaagcggcgcgaacggatgatcttatacggttcgatctgcggcttgtgaaaatcgttggaggtcataaagccgattttgagcgcggggataaacaggtgatcgattttttcaaacgggaacagcggacaataacaggtgatgacatcccagcccatttcgagagcatggctgcgcagcgcgctcagcataagccgggaggcagccccatatacgtcgtcgatcagatagaggcggtcgcacagcgcgcgggctgtatcctcaaacatcaaaacgcccttgttggtcacgcaggaaagaaagcgcaccgattcgcggccgcgcccctccggcccgcccttgaaggcgccgagcgccagacgccgcgccgcctttgccaccttggaggaggtggtggcgtcgagcgcaatgcggtatgtatcgccggtaaggctgccagccgcgcccaaaaagcggcagcaatgctcatggcaccggctgattcgcgccgaaagcgccatgatcgattcacgcgattcgaataatgcatgttcatcccagcaggaggacagatcgacaatctgttcaaacgcaccgggatattttggttcgatgacatgggatgccgcgcttaaaataaaaaccgttccgatttacttttttcctgtttcgtattatgataaagtacaacgtggagcattcttccgcagattgtttgcggcagaaagacggaaaggaagatgtattttgaacaaacggcgattgggcaatacagggctgcttgtcggcgaggtcggtatgggctgcgagggctttttagaaaaaacgcccgaggaggtttcggcgatgatcgaccttatggaggggcgcggctgcaactgcatcgacctgtatactccgaatcccgagatgcgtacaagccttggacgggcgctgcgtggccgtcgcggccggtttgtttttcaggcgcatctttgtacgatctggaaggatggtcaatataaacgcacgcgtgaaatcggcgaggtgaaagctggttttgaggatttattgacgcgtatggagctttcatccgtggagatcgggatgattcattatgtcgattcaatggctgattgggaggaggtgtgcagaggcccggtcatgcgttatgcgcagcagctcaaggcggacggtgtgatcggacatattggactttccagccacaatcccgctgtggcgcacaaggctgttgaaagcgggctgatcgaggtgctgatgttcagcgtcaatccatgctacgacctccagcccgcaagcgaggacctggagttgctgtgggctgaacaaagctacgagaaaccgctggtcaatatggacccggagcgcgaggcgctttatgaggcatgccagcggatgggagttgggatcaccgtgatgaaggcgttcggcggcggcgatctgcttgatgagacgctctcgccggccggccgcgcgctgacgccgtatcagtgcatgagctatgcgctgacccggccagccgtggcctgtgtgatggccggagcgcgcactctggacgagctgcgcgaatgtctttcctattcggacgcttctcgagagcagcgcgactacgccgccgcactcgcttcgtttcccaaaataagctggcaggggcactgcatgtattgcggacactgcgcgccctgccccaaggggatcgatattgcatccgttacaaaatttttaaatctctgcaaggcacagggcggcataccggagacagtgcgcgaacactatgcggcgctgccgcggcacgcatcggactgtgtcgcatgcggcgcctgcgaaaaacgctgtccgtttggcgtgccagttatagagaatatgaaaagcgcggcagagctgtttggaaaatgacacggctgttcatactgctgtatgcgggtcgttatgcggcatatgtatcaatgaaaggggaaatatagtggatttgctgattcatgatgtgaagggtgcgtccgcgaaggcgctgattaccggagcatttgcgggcgcacaggtcatcgcggatgatggacctgcgcgcccgtgtatcggctgtttcggctgctggattaaaacgcccgggacctgtgtaatccgggacggctatgcggatatgggcgcacggctttcacgctgcaaaaggttgtttattgtcagtcagtgtgtttatggcgggttcagtccgtttgtaaagacagtgatcgatcgcagcatctcctacgtacatccttattttgtgataaaaaatggtgaaatgcatcatcgggggcgctatgaaaacaggatggatttgacggtttggttttatgggaccgacctgacggacgcccagcgcgcgacagcacgcaaatttgtacaggccatggccgttaacttctattgcaggttaaaccaagtctgctttgtcgacgctcccgatgacataaaggaggcgccggcaaaatgaaaacagccctgattaacgccagcccgaaacggacgggcagcgcctccgggatgttgctcgacgcgctgtatcccagactggagggctgttcgtgtacggaattcagactcggaattgaaaaaccggatccgcagattttagagacgttcgcggattttgacgctttggtatttgcctttccgctttatgtggacggcctgccggcgcatctgctgcggcatttacaggcgctggagccgctgcttttgcagcggccgtgcccggacaggcgcgtttatacgctggtcaactgcggattttacgaagggcggcagactgcctgcgcgctggagatgatggagcattggcggctgcgggccgggcttgaccgcggcatgggccttggcgtcggcgctgggccgatgatgctggagcttgcaagcgttccgcctggacatggtcccaagaaggcattgggggaagggttggacgtattggccgcgtgcatcaagaacggtgcgccgggggaagaccggtttttgtcagtcaattttccgcgctttgcataccgtctggcagcgcaggcgcattggagacgattggcgcgcgccaacaacctttcggcgcgcgacctgttccgcaggattgaaagcgaatagaaacagagcagccggcccgggcatatgattgcccgggccaatctgtttaaaaagggcttgatttcccgctgcaaatgcgccacaatagaagaaaagcgccgtcctgccggggcgggccatgcgggtgaaaaatgtacggggaggcgtagcggatggaacaggaggaaatttaccggtatctggcgcggtcgttcccggtatgggaacggctgaacgcgagggaacaggccggcctggcggaacataccgcacaggtccattatgaaaaaggcgcgcgcctgcacggcgcgggaaccgaatgcatcggcgtgctgttcgtcatgcgcggacggctgcgcgcatacatgctctcgcaggaggggcgtgagattacgctctaccggctgggagcaggggaaatttgtatcctgtccgcgtcgtgcgtgctctcagagatcacatttgatgtgcatatcgacgcggaggaggacacagacgcgcttttgactggcgcgccatatttttcggcgctttgtgaacaaagcatttatgcggagtgcttttcatataagctggcagcggaacgtttttccgacgtgatgtgggcgatgcagcagcttctattcatgcgcatggatcaacggctggcgatccttttgtgggatgaattttccaaggcgggcagcgacgtgatccgcctgacgcacgagcaggctgcacgctgcatgggaagcgcccgcgaggttgtaacgcgcgtgctcaggtattttgtcggggaggggatcgtctcgctttcgcgcggcagcatccgcctgcttgaccgcaaaaagctgcgcgcgctggctttttccggagaggaaggcgtatgaatatccctgccggtcaggggacggcgcggcttttcggggtgtttcccgccgttgacggcgtttaaggggaaggaaaacgataaagtatgggcgggcgcggccattggccgcgcccgcccatactttattctgtatcagcgtcccttatacgccgagcatctgtaagatctgcgccttggaacgcacgccgaccgacgttccggtcagcttgccgtcccggaaggctgcgagcgtcgggatgctcatgactttgaaggtctgcgccagttccggctgctcgtcgacgtttaccttgcacaccttgaccgacggcgtttcctcggcaattgtatcgagaacaggggataccatgcggcatgggccgcaccacggcgcccagaaatccacgaggaccggacggtccgcgttcaggacttcggcttcaaagttattggaagttacagtgacggttgccataatcagatcgttcctttcatattaaaaacttattggagttacacagcgaaaattcgcctggaaaaggagcggagctttggcgcgagcaatccgtgcgcggattgctcaccgccgggcgctgcgcttgcccggccggctattcggggctttccggcgctataagcgccgggcgcggacaagccgcggcaacgccccttttcgcgcctcacaaggggcgggccggcgaccctccccttatgttatccccacctctgtttggcgcgatcgtatcgggcgcacgccagtacgtctggagggggatcgtttaactaaacctgccccactgttcgcggcgcagccgactaaagtttttcgccgaagcctttcttcaaaaaggctggagcgcagccgactaaagttttttgccaagctttttttcaaaaaagcgggaagtgggtggagcggtaaaagtgcgtgccgccgggatagacgaggacgtttttaaacccatgggccgagaggatacgcgacgcgttgtaagcgcgcacgccgacggcgcacaatatgatgtaacgccgcgcgggatcaagttcgccgatgcgttcacgaagctgcccgagcgggatgtgaaccgagtccggaagctcgaacgcctggcgttccatagtctcgcgtacatcgagcacaaccgcgccgtctcttttgtcgagcgcgtcccaggatgagaacgccactttgcctgtcagaaggttttccgccacataaccagccatattgaccgggtccttcgcggaggagtacggcggcgcataggccagttcgagctttgtcaggtccgaaacgcccgcgccaaggcgaatggccgccgcaagcacgtcgatgcgcttgtcaacgccgtcggtcccgacaatctgcgcgccgaacagccgtttgccgtccatagagaacaacagctttaaaacgagcggcgcagcgccgggataataggcggcatgtgagttctgcacaatcaggatgctttcatagtcggcgccctttttcatcccgcgccggatcagcgccttttcattcgcgccggtgctggccgccgtaagttcaaagattttagccacagaggtcccctgcgtgccgtcatagctctgctgtgcgcccgcgatgttgtcagcggcgatgcgcccctgcttgttggcagggccagccagcggaatcatcgtgcgttcgccgctgatgaaatcctgcacctcgattgcgtcgcccaccgcgtagatcgcggggtcgctggtgcggagaaattggtcggtgacgatgccgccgcgcgcgttcagcgcaagccccgcgtctttggcaagcttgctgttcggacgcacgccgatggaaaggatgaccagatcggcagtgacagtacggccgctttttaagcggaccgtgacggtttcgtccgtgtgttcgaacgcgtccacgccgtcgcccaggcggagagaaacgccctgctgctccaggtgcttgtgcagcataagcgccatctcataatcaaggggcgccatcacctgatcgagcatttcgatcattgtcaccgatagaccaagccgccgcaggttttcggccatctccagcccgatgaaaccgccgcccacaacagccgccgatttgacgccgcgctttgcgataaaggctttgatttcgtcggtgtcgggtacggtccacagcgtgcggatgcggtcgctgtcaatgcccgggatgggcgggcgcagcggttcggatccggttgaaagaatcagcgtgtcatagctttccgtataacgctcgcccgcggcgcggttttcaaccgtgaccatccgggcctcgcggtcgatggagacaacctccgaacagacgcgaacatcgatattgaaccgggagcgcatcacctgcggcgtctgcaaaagcagcgcctcacgtttggggatggcgcctcccacgtgataaggcaggccgcagtttgcataagaaatatactcgccgcgttcaaacaaaatgatctcggcgttttcgtcgagcctgcgcaggcgcgccgccgcgcttgcgcctccggccacgccgccgacgatcagtacctttttacccatttaaaatcccctccggctgtatgatctgttgggttcagtatactggagatccgcacgccgttcagtgactgtgtcacagttaggatgcctggaaagcgcaatttccagatcaggcggctggcggaacaggaaacaagcgcagagccagcgggtagtagaagcggcgcggcatgaatacgcagagcaccctttccgcaatacccatcgcgccgccgcagtggcaaaccggccggccgcgttccagacagcgaagcgaccgtgcggcaacggtctccggttcctgccagcgcataacgccccgatttctttgtttgcccttcggcatccccatctttagctgaaaatccgtccgtgtcaaaccggggcacaacgcctgcacgcgcacatgactgccgcgtccgcgcagatccagataaagcccctctgaaaattgcttgatgaacgctttcgtaccggagtagaatgcgtttgccggaacaatcatgtaagcggcgtccgaggcgacgttgatgattgcgccgctgtcgcgcgcacacatctgctcaagcgcggcatacgtcaggcggacggtacagccgatatgtacgcgttccatctgcagatacggctcgagcggtccgtcctggaaacatccccgcaggccaaatcctgcgttgttgacgagcagatcgagctgtgttgcgcggatgagcgcctcaatcctgcaaatgtcccgttcatccgaaagctccgccggcagtaccgtcacctgcacgccgtactgtgcgcgcagcccagcggctgtttgttcaagcagggcttgccgccggcccgttaagataagattgctgccctgcgcggcgagcgccccggcaaaggcacggccgatgccgctggtcgcaccagtgatcagggctgtttgataaatttgcattatgattcctcccttaatgaataaatattattcaattaatttagaaaaaaagaacgccgtcagacggcattcaagtaaaggatcagcatgtgggggcggccgcgtcgagccatgcgacaacccactgctgcacccggcggaaacgctccccaccaggcaggtcaaaccgggtcagcaaaccaagctgtccccagatcagaaacgaagcatcagactccggatcgtttgagacaatttcgcccgctttgattgcgtgttccaattgcttttgcacaaggggcgtaagcagctcacagacgcgcacggacaaaatttgatgcatacggcgtccgctttcgctgtggaaggcgttgtaaaagccgcccgcctcgtagtgctcgggtgcgggcatttcaagcatgcgctgccgcagcgattttgtcccgtcgcacaaaacaggggagagtatgcgcacctgctgctgggcgtactgatcgacggcacagtcgagcagggcctgtttggagggaaaataacgataacacagcccctgcgagataccgaggcgctgcgccaggtcggccatagaggcgccctcatagcccttttcacagaacaggtccagcgcagcctccaggatctcctgccgacggacctccggctgcttaacagtacgccccataaacttccccccattcagtcatgcaggaagtatagcacagatcgggaggtctgtcaatgaatccaattcaatagatgggtgcggcggttaattcagcgttttttcgtctgccgtttggattaaaaagctttagccgtctgtgtcaatcgctgatctttggttaaaaacactaaaaaagcagttgaacttatccgccgatatggtataataaccgcaaagcggttattataccggggttgtgcccaacggctcgccgcttgcgcggcaaccgccttttgatgggcaattataccatgccgcttcgcggactcggcctaatcagggtaagattttagagaggaattttgcatgaacttatttgtttcaatggcgttttgcatcaccacctccattccagccacctgtattgcgcttatctatgcggagccgtttccgaaaaagcgggggcactattgttttttggctatgtgtatcctgtccgcgctttggaatatcggatacgcgggaatgttcatttcacaaaacccggattatacccgcggcttctatcggtttgtgctgatcggctcgctttttatttttccgctgatgttcaagctgatggaggagatcagtgaacggcggtattgtccgcttcaacaatttgaaatttacatgaccgcgcttgccgctatgctgtttgtgattgtggcgcgcagagaaaacctgatgctcgtgcatttggattggggcgggcttgatttctgtgtgcctcaggcgggtggggcgactgtcctgctcatcgcctattatacaattatcggtttggtgtttttatactcgctgtatcaatgggtcaaggcggagggagaaaagcggcgtgtgcgcgagcaggctggttggctgtgcctgtgtgttttcgtctgctttttggcactggcgctggaatacggcagcctgtttgtcggaatgccgtcgattccgatcgggggcatttcgaacctgctgttgcttgtaatcacgtttatcatggtccggcgttacaatacaatccagatcaatacgcataattttgctgaatatatctattcctcaaccaaaacgccgatcctgatttttgataatgaaggccggcttgcactggccaataaatgtacgcctctttttttcgatctgcctgccggcgcgctgatggggcgaaggccggaggatttgttcctgcgcgtaccggccgacggcgtgggggagacgcatagtgattcccctgtgcagatgacacggttcaactcggtttgccgcttcaataagaagccgtgtgatatcacagtgacaaatgtatacgacgcatacagcgaagtaattggaacgatctatgtggtgtacgatatgactgagaatatgcgccgtattcagctgttggaccgtatgcggcgcgcagaagttgaatccaaccgcttaaaaagcacgtttctggcgaatatgagccatgagatccgcacgccgatcaatgctgtgataggcatgagcgaaattctgatgcgcaagaagctgccagacgacctgcgtgccgacgtcggcgtcatacacagcgccgggcagggacttttggcaattatcagcgaaatacttgacttttcaaaaattgaatcgggcaagttcgaattgatagagacggaatatatgctgccggcgctggtcgaaacggttgtacatattatcggcgtgcgcttttccaaaaagccggtatgcctgttgatcgatatcgaacccgatacgccgatcgggctgtttggggataaccagcgcgtccagcagatcctgctcaatcttctgagcaatgcggagaagtttacgcagtccggttatgtccgtttgtattggagatgggaacatgcgggcgaggatatggtgcggatgattatttctgtcgaggataccggcagcggaatccgcccggagaatcttgaaaagattttcgcgcagtaccagcaggtggatgcaaaatccaaccgcgcgcttgtcggcacggggcttggccttgcaatcgggcgcgagatggcgcgcatgatgggcggcgatatcactgttgagagcgaatacggaaaaggctctgtgtttacagtcacgtttctgcaaaagattctggacaatcgccccgtttcctatatgcccgagggcgtgcatgccaacgtgttgatctgtggagaaatcagatgcgtaaagaagtctattgaattttactttccgcgccttggcgtggattatacgctttgcacttcccccatggaagccatgcgctttgatccaaagacgtatacccacgtgatggcgcctgcggccgagatacgcgctctgcgcgcggtggacggatgggcgcacatccggttcatacagattcttgaggcgacggaatatgttgaaacgctcgacggcgacgattgcatccatctgcctctgcttaaccgaaggattgtacgcgccctgtttggagaggataaagccgcgcctgatatcgtatgggagccggagcggatggaaaatgtacgcgtgttgattgtagacgacagtcctgtcaatctccaggtcgcggccggtctgctggagccgtatcacatggcggtcgatctggccgcgagcggagctgaagcgattgaactggcaaaaaagaatttttacgatctggtgatgctcgatcacatgatgcctgaaatggacggtgtggaaacggcggagcgcctgcgcgcgttgcctgattatggcagagtaccgattgttgctctcactgcgaacgctacaaacacagcgcgcaaaatgttccttgaaaacggtttcgacgattttctggctaaaccgatcaatctcctgcagcttgatcttctgctgaaaaagtgggtcggctccagactcagtgacccggttgcggttgccgcgccgccgctcgatatgagcggcggcgaaggattgcaggagcgcaatccttcgcttgatatccctgttctgcttgacacacaggcggggatcgatgcgttggggggcaacctgccagtctatacacatgtgattgatgcgttctgcgtggatgccgtacagcgtgccgatgaactggaaaagctggcggatagcaacctccgggattttacaatttcggtgcacgcactcaaaagcgcctgccgttcaattggcggcgcgcttgccgctgatgaagccgcgcgcctggagcaggcaggcaaggagggcgatgaagcttatatagggagcgcattgccgtcgtttctggcgcatttgcgcgcgttgattaccgaggcgcgcaaatggcttgaggagaacaaggcgcaggaggcacccgggaggcaggcgggattaagcagcgcggaagaaatccgcgggaagctggcgtccctgcgccgggcgtgtgaacgcgctgaaatcaaccgcgcggagaagctcgcggacgagctgttggcggagatttgtgatgaacggatacacttggcggttaaggctgtgcgtgcatcgcttggacaatttgactatatccaggccgtcgatcagatcgaccggcttctgaaggaggaaaactatgcctaaaattatgattgttgacgacgatatcaccagcctgagcatggctcgggcgattctggaaagcgagtatacgacgattccggttcgctcgggttatgaggcgttgcgcctgctggcggccggagccgagccgccggatctgatcctgcttgatatcaatatgccggtggtaagcggctatgaggtgctggagaagctcaaggaggacccgaagctgcgcgaaatcccggtggtatttgtaagcggtgaggacgcttacagcaatgaggtggagggtttctcaagcggcgtcaaggattatatttccaagccttatatcgcaagcacgctgctttcacgtgtgcgccatcatctgtcggaatgtgaacagcagacgcgcctgatcgaacagatggacctgctcacagaggagaagctcggcgagctgatgaatctgtttgacacgctgaccaatgcgatggcatatttaaacagccgccgctgcccgcagctttcctggcattccaagcgcgtttcccgttatatgcgcatcctggccaccgcagtggcggccagccagggcggcctttccgcaggcgatatcgacgcggtatcgcgctgcgcggccctgcatgatatgggactgctggcgcttgccgacagcgatttggagaaatacaagaatgtcgagcttgcgcgcacgcgcggctcgggcgacccacaggcgcctgtggcggcggaaatagaattttatacaaaacatacggttgccggacgcgattcgctccgtgtgtttatggaggatcatccgaacaatctttatctgacgtacaccttggaaatggtgacgcatcaccatgaatggtggaacggcaaaggcgcgccggatggtctggagggcgaagcgatcccgttgtcggcgcggatgatggctattgtggataactatgacatcattacggcgcgccgtgcctataagtttgaatatacgcatgaggatgccgttatttccatacgacgcaacgcgggcgcccggttcgatcccgcgcttgtggagatctttttgagcgttgaggaccagatgaaggcgtgtcttgggcgcattgtccaaaatatttaaataacgcccggaaggctatagccttccgggcgttttaaagtcagatttaaaagcagttggcgccgggataacgcgcggctgcgccaagcgactgttcaatgcgcagcaggcggttgtatttggcgacgcgttcgctgcggctcggcgcgccggttttgatctgccctgtgcacagcgcgacggccagatcggcgatggtcgtgtcctctgtctctccggagcggtgcgagacgatcgcggtatagcccgcgcggcgcgccattttaatcgcgtccattgtttcagtgagcgagccgatctgattgagcttgatgaggatcgaattggcgcaatgctcctcgatgccgcgcgcgaggcgctgcgtattcgtgacgaaaaagtcgtcgcccacaagctgcatgccgctcccaagctgcgcggtcaatgttttccagccggcccagtcctcctcgccgagcgcgtcctcgatcgaacgaatcgggtattttttgcaaagatcctcccaataggccgtcagctccgcggcggtcaggcgtgtgcggcgttttggaaggaaatatccgttttcatcggcccattcgctggaagccgcgtcaattgcgagaacaaagtcgtcgtatggcttatagccggcctgctcgatggcgcgcagcagcacccgtacagcgtcctcgtcgctggagagatcgggcgcatagccgccttcatccccgacggcggtcgaatggccgtcgcttttcaggatgccggcgagcgtgtgaaaaacctctgcgcaccagcgaagtccttcggaaaatgacggcgcgccgaccggcataatcatgaattcctggatatcgatgttgttggccgcgtgcgcgccgccgttgaggacgttcatcatcggtacaggcagcgtgtcggccgccgcgccgcccagaaagcgatagagcggcagaccgtatgcggcggcggccgcatgggccgccgccagcgagacggccaaaatcgcattggcgcccaagcgcgatttgtcggacgtgccgtcgagcgcgatcattgcgcggtcaacggcggcggtatcgcacgcgtccatgccggcaagcgtgtcgcaaagctcgctgtcgatgtgcgaaacggctttgcgcacacctttgccgccgaagcgggccttatcgccgtcgcgcagttcgagcgcctcaaattttccggtggaagcgccgctgggcacggctgctgtcccgcaagcgccgttttcaagctctacgacggcttcgaccgtcgggttgccgcgcgaatcgataatctcgcgcccgtatatttttttgatctgtgttttcataatacctccgatgcggggcggcctgtttggccgcagcctgtttttattgatagtatgggcaaacggcgggcgcttatgtttgcatggggaaaggccgccgcaaaaatcccgtcgaatacagacggcgcgcggcacaaaggccgcgcgccgtccggtctgttttatagaaaatggattgataagctcaaacggcccggacgattgcaaaggtgtgtcagaatccggccagaccgcttccaagcgcccggcagtcggcaaggccgctgtcgtcgggcgtctcgttgatcatcaggccctcgccgttaaagagctgcgcgcccgcgccggtcacgcggtcctgccaatcacgcatccactggccgtcgccccatccgtaggagccgaacagggctacccttttgccggagagcttcggttccaactcggtaaagaacggctcgaactccgcctcctcaagcacttcggcgcccatggccgggcagccgagcgccagacgcggatactctgcggcctggtcggccgtgatttctgaaacagcaaaaatctgcgcgtccgcgccgccggcgcgcgcgccttccaggactgcttcggccatggcctgcgtgttgccggtttggctccaatagatgactgcgagtttttccatggtggttgacctccttgattaatgactgactgtattgggtttgcttacgcggcagaaaatagctgcacgatcgattttccagccgccacgcggcggcacagggcctcccggcagcggttgaatcggacaaagagggcgcgggcttcctcctcgttgccgtaaaccttccaatagccgctgaacttataatttttgccgccgtcccgcaaaaatccttccacatccgcgagcggataaccgagaatgacgcctgcttcgtgcgggaagctgccggcttgcgacaggcgcgctccaaaatggatgagcgtagcctccaggccgccggacgggtagccggcacgctttaaaaatgcgcaggcgtcaggctgcgcgaggtgaagttcaagcagtgcgcgccggtacacaagcagcagcacgcgcccgctgcaccggcataccggcctaaaatacaggccgcggggattgagctgacggttgagtgcgagcagctcccggtcgagcgagggataacgcgcgagatcacagcagatcaggttggatggcttgatgccggcaagcgcgggcgcgcagtgaaacgccagcgtatgctctaaagaaccgttcataggaacgcctgcctttctgtttgatcatcgttagtttatgcgttgtgccctcaaataaacagcgtccgcggcggtgtggcggtgcaaaatctgatagttagcaataactaacttattgccaatcgtatcatccaaacctgcgtttgtcaagagggagataagcaaaaagtttgaatcgcttattttgaatcgcttattgggacacactttttttatcaaactcaaaaaaagagggccaatcccattgacaaaattagttagcggtggtaaactaacaggcggtaagaggttagttcattctaacctgtttttacagcgcaatggttagcgaattctaactttggagggtggttaaaatcatgccgcttacgatggcccgttcgggcgaagcgattacgatccgcgcggtccgcgggaaggatgaaacccgccgctttctggaaagcctcggctttgtggagggcggctctgtcaccgttgtatcggagatggggggcaatctgatcgtcaatgtaaaggatacgcgcgttgcgctcagcaaaagcatggccaacaggattatggtgtgagggggtacagcatgagaacactgaaggaagccaaatgcggcgagacagtcaccgtcacaaagcttggcggagagggcgcgctcaagcgccggattatggatatgggcattacaaagggcacgtctattttcgtgcggaaagtggcgcctctgggcgacccggtcgaggtgacggtgcgcggctatgagttatcgctgcgccggagcgacgcggagaatattctcgtcgattagaggctgcatgaaaaatcagattcccgttttttcctgtaaacagcggcgaatgctgcgttaaaaagcctcggaatccggaagggttccagtgttttttgccttgctttctcccgttgtctgcgaaaaatccggcaattcttttattatcaaacaagccctaaagaggacttcgacgcccgtctggataaccggcgctggcgccgctgcaataaattgcaaacagccgagggccggtcagccggccgcccgacttcaaaggccgcatggcggccagcgggaggaccccgcagaggaggtaatcaggaatgtcaatcaagatcgcgctcgcaggcaatccaaactgcggcaaaaccacgatgtttaacgatctgacaggatcgtcgcagtatgtcggcaactggcccggcgtcactgtcgagaagaaggaaggcaagctgcgcggacagaaggatgtcattatcacggatctgcccggcatttacagcttgtcgccctatacgcttgaggaggtcgtcacgcgcaactacatcatggatgagcggccggatgtcgtcgtcaatctggtcgacgcgtccaacatcgagcgcaacctgtatctgacgacgcagctcacagagatgggcatcccagtgctgatcgcgttgaacatgatggatatcgtcaagaaaaacggcgaccgcatcgatacgaaaaagctttccgaacagcttggctgcgagattatcgagacgtcggccgtcaagggcgaaggtttaaaagcgctggcggactgcgcggtcaagatggcgcggtccggtgtgaaaaccacgccgcagcacacgttcgaccagcgcgttgagcaggctctttccgaaatcgcatctctgatcagcgatgtggttccggccgaaagtctgcgctggtacagcgtcaagctgtttgagcgggacgaaaaggcgatggaacgcttttcattcgctgccgatacaaaggagcacctcgagcagatcatagccggctgtgaaaaacagttcgacgacgacagcgaaagcattattacaaacgaacgctaccagtatatcggcacactgatgcagagctgtgtacataaaaagaaatccggtatgacaacgtcggataagatcgatcagattgtgacaaaccgcatcctggcgctgccgatttttgcggtggtcatgtatattgtttatttcgtatcggtttcctggcttgggaccattgttacagactggacgaacgacacgttgttcgctgaaacgattcagcctgctgtcgcgggcgtgctcgagagcatcggcgcggccgcctggctggaaggtttaatcgtcgacggcatcatcggcggcgtgggcgcggtgctcggtttcgttccgcagatgtttatcctgttcttcttcctgtccatcctggaggactgcggctacatggcgcgcgtcgcgtttatcatggaccgtattttccgtcgtttcggactctccggcaagagcttcatcccgatgctgatctcctcgggctgcggcgtgccgggcgtcatggcgacgcgtaccatcgaaaatgaaaaggaccgccgcatgacgatcatgacgacgaccttcatcccctgcggcgcaaagttgccgatcatcgccctgatcgccggcgcaatgttccccaatgtcacctggatggctccggccacctatttcttcggcatctttatggtcatcatctccggcatcatcctcaagaaaacgaagatgttcgccggcgacccggctccgtttgtcatggagctgccgcagtaccacttcccggcgccaaagggcgtgctgatccacatgtgggagcgcggcaaggcgtttatcatcaaagccggtacggtcatctttgtggcctgcggcgtaatctggttcctccagagcttcggttttggtcctgatggattcggtatggtcgatgacgagaacatgagtatgctggccgctatcggcaatgtgctcgctccgatcttcgccccgctcggctttggaaactggcaggcggctgtcgcgagcgtctccggccttgtagcgaaggagaacgtcgtcggtacgttcggcgttctgtttggactgggcgaggtaggcgaggacgatccggccctgctggccgctctgcccacactgttcgccactcatgcaagcgcgcttgcgttcatggtctttaacctgacctgcgctccgtgcttcgcggccatcggcgcgattcgccgcgagatgaacagcgccaaatggacatggttcgccatcggctatatgacgggtatggcttatgtgatggccttcatcatcaatcagctcggcggcacgattttctatggcgttccctttggaatcggccaggtgattgcgctcgtgcttgtagccgctttgctgtggcttttgttccgcagctataaacccgccggaatgtccaagcgtccggccgctgccggcgcccgtgcgtaagcagaccggcaaaggaggcgcctttctatggtaaactggattattggcggcgcgattatattggcaatgttttttgccgctcgctatgcatggcggaaggctaaaaacggccagtgcgtcggctgctccgactgtaaaagcggcggctgccactgcggctgcggcggggacagcgcggatcacgccaaaaaaacctgacagttcaaaacacccgcggacagccaggctgtccgcgggtgttttttcctgccggttccttttcacccggcaacggccttgtcatatgccagcctgccttccccctgaaaaacaatcgttccacattttagaaacccgtttttctccagaatgtgctgcatacgtccgttggaaaagtctgtatcgacccggatgctcttgacgccccgcgaacggcacaggtcttcaatcagaagaaatacgcattttgtcaaccccgtgcctctgaacgacgcatcaaatgccattctgtggacaacggcatatggttttattgtatgccagccgccccggatatgatcatacgcaggctccccttcaaaatcgatacacatatacgccgcaattttatccccgaacttcacaacgtatccattttttctttcgatatcatctctgatagtatcgacatttggataatcgtctgtccattggacgaacccctgttccctctgaaagcgtttgcctgcttctatgatttcataacatcgattcaattcgtccatccgagccagttccaacggctgcattgctgcgtctctccttaaaaatttatttttccttctgagtatatcagaaaagaaaggtaaatgaaatatgagtgagcattccaactgtgtcatacaaaaagcgggcgtttagagcgcgcttgtaaattgccgcgcggtatagtaaaataaccgtgatacggttattttactattatatggccatgccgctttgcggatatggagccatgtaagctataaaccggcagccgtgctgtatgcacggccggaaagggattgcatatgatacatttcaaggctgtgcagccggtcgccgtgctcgcggccctgttgatattggcgggctgcgcgccgcgcagcgcggacaagccgcagcagacgccgccggatacggcagcgccgccgccgctttcggccgccagcagttctgcgccgaaggcagggccggcggctacggggctggctcttaaaacgcccggcacggcgacgctttaccgctttgtggcggcaggaccggatgcggatgattatgtttatacgccgctggaacgtgaggcggcggatgcgatgacagccgtgctgcttgatacgatcgtaagcggggatgatatgcagcccgcctttacagtattgtcgttgaaactggagggcgcgcgcgccgtggcggaggtccggtcgaacctggacgcgcagacggctcaaacagggcggcggcgctggcttgacacagcggcgcagacgcttttggagagctgcgccggggttgatgaggtgtcgtttgtggagaatggcgcgccggtagctgaacagggctttgcagacagctacaccccgccgccgctcgtgctgcctgcgctgacgcgcggggaaattgcctcgctgcgcgctgggatctcctacgacgagctgctcgaatggacgcgcgtgtatgagacgcaggcgttcggcgaacaggcgacgccgcgcggccgctgggatattgcgggcgatgaggagcgcggccgcgcgctcgactttatagcggacgttacgaacgctaatatcccggcggagccgtttgattcggttgcagaagcgccgggccgttttcttgtcagggcggcagtactcaacacgccgtcggtcaattggggcatgtacggcggcgaaacatatgaaggaatccccacctatccttcgctggagccgctgaccggcctgatcggcgacagcacatgctttttgcaggagcatgttgaaattaccgccaaaaggctgttcggagacagcgtgcccctggttcacagcggcgcgggactaagcccctggcgctaccatgaatacgccggcgtctatacgccgccgcatatggggacgccataccctgattgcgtgctgcttgattacagcgcgtcgggagaaacggtcgaggcgaccgtcgggtatctcaatggatttgccttttccgaatcgcgctatggcgaggatgaacagacatatgcgaggacgcgtctgcgccgttaccgttaccatctggaacgcgccggagaatcgtttattatgacggcgtgcgaatttcttgacgacgacttgtcagcggcggcgcgcgatccggaacggattgcacgtgcggctgtcgacgctgggctgacgcttgcggattgggacagtcctgaaagtctgacgggcgaccagctttatgcgcttttttatgcggaggcgaacggtctgtatacgacgctcggtgagacgcatgtcccatgggaacggattgccggacgttttccggggcggcaggcggctctgcgagacagccgttattacaatgaaaccgctgtgaacagcgacggttcaggcgggggcgcgttcaccggcacgccggacgcctatgccgcgcgctggtgcgattatggagagatgacctttgccggcgatgcggccagcctgcccatgacggtgtatgccgatgcgcagcgtacacagactgtttccaaaggcgtgatgacctttgcggcggatgagtcgggatggacgcccgttggctggcgtatggatggagaggagtaaagatatggcgacactttttgtagtggggcttggtccaggcggcgcgtccgaccggacggagcgcgccgagcaggcgctcaaacaggcggaattgatctgtggttatacagtatatgtggatttagtccgggagcagtaccctgataagcaggtgcttacgacgccgatgacgcgcgagatagaacgctgccgcgccgctttggaagcggcggccagcgggcgtgacgttgctatggtgtgcagcggcgacagcggcgtgtacggcatggcaagcccgctgtgccagcttttgccggaatatcccggcgtacagcttgagattattccgggcgtgacggcggcgcttggcggcggggcggtgctcggcgcgccgctggcgctcgatttcgcggtgatctccctaagcgaccagctgactccgtgggcggtgattgaaaagcgcctgcgtgcggctgcggccggtgattttgcaatctgcctttacaatcccgaaagccgcaagcgtcccggctatctgcggcgcgcctgcgatattctgctggaatgccgtaatggggagatcatatgcggattggtgcggaacatagggcgcgcgcagcagagcgcgcagattatgacgctttcaaagctgcgcgacacgccggcggatatgtttacaaccgtgtttatcggcaacagtacaacccgtgtcatcgatggacgtatggtgacgccgcgcgggtatgagcagcggctcggtccggatttgcgctgattggccggacagattgacgataaaggggtaagatgatggaaacagcatggctgaagaactctaaaacaacccgctatggaagcggttcccgcgctgcggccggcgatctaaaacggaaagcgatcctcgccgtatcattcggtacaagctatcgaaaaacacgcgacgctgcgatcggcgccatcgaatccgatttgcaggcagcctatcccgattatacggtgcgccgcgcgtttacaagccggatgatcctgaaaaagcttcgggagcgcgacggcctgcaaatcgacacggttgccgaggcgctggaacgccttgccgccgaaaacgtgggcacgcttgttatccaaccgacgcatgtgatgaacggcattgaatacgaccggatgatggccgctgccgcgccgtatcttgaccggttcacggcggtatcgttcggcgcgccgcttttaaacagcgcggccgattatgacgctgtggcagaggcgctgatcgcggagcttgcgccggcggacgatacggcgcttgtactgatgggacatgggacggagcattttgcggattccgcctatgccgcgctcgattaccgcttcaaagcgatggggtatccgaatgtgtttgtcggtacggtcgaagggtatccgctgcttgagcatgtgctggccggaatccgggcgggcggctatcgaaaggcgttgcttgccccgctgatggttgtcgcgggcgaccacgcagtaaacgatatggccggcggcggccccgattcttggaaaaatcagcttttgcgcgcgggctgccaggtgcaatgcgtgctgcgcggcatgggcgaatacaaaagcatccgcgcgctgtacacggcgcatgcgggcgctgcaatcgcggcgcttgccggcgcggcggagtctgcgtaaaatccgaatcgtgattatatcctgagaaagcgccctgccgcctggtcagacggcagggcgcttataagagcctgttcagaatctccacgcacacgttttgacggcgtattttctgccctgactgcgttaaaaatccatgcgcttccctcaattgaaacggcttctaaaacttccagaaaatgcggactgcctgtgtgtcctgcaggggatcgcgttcatcaatttcaatccggtcgatcagcagcgtcgcgagcgggcgaaaaaaccgcccgggcgagagcagttcccggatatgctgcgccgtacaggccggcggggcgtcgtgcgcttgagcggcttgcgcctcaagcgccgccaggtgagcgcgcagcgtgtcggcttctgcctgaaacgacgcgcccaacgcggcgaactgctccggtgtaaccgttccatcggcgcggtccagatagagcgtgcgcaaagccgcctcacggcgcgcaagctgcgtgcgcagcgcggcaagctgcccgctggccgctgcggcgcgcggtttttggggaagatcgcggatggaagaaccgggagtataccaccgcgcgatttgttcgcgcagctctcgttttaccgcatctgtcaggatgtccaaacggatggaatgcctcgtacacagcgcgcccgcccgatcggacgcatatcgtccgcattgcagataggaccgctttttccctttataggtgtgtgaaacacggatcattgacgcgccgcaagcgccgcagcggacgagtccggcgagcggatgcgtttggccgctcccgtcgctgcgcgtgcgccgcgcaagcacggactggaccgtttggaaaacctgcggatcaatgatcgcctcatgcgtgcctggaacacgtatccacgcttcgcgcggcacgctgacgcagagattcgatttgtagctgattttatgcttgacaccctgcaccattgtgccggtataaagttcattatgtaaaatccgtccaactgtcgcgtggctccaaagcgcgcttttgccgccaggacagatccagccgcgcgcacgcttgtaggctgttggattcagtatgccgcgccggttgagctcggcggcgattttctgtttgcccattccggaaaggcagagcgaaaaaatgagccgtactgtttcggcggcctgcgcgtcgatcacaagatgattgtgatctgccgggtccttttcatagccatacgccgggaaactgccgatatactgcccggcgcggcgtttttgtgcaaagactgcccggatgttttcagacaggtcctccagataccattcgttgacaagcccgttgatctggcgggcctttttgctgccgcgcagcgccgtatccacatggtcgacgaccgcaatgaaacgaattccccacacaggaaaaagcccgtggatatatttttccacaagctccagatcgcgcgtaaagcgcgactgcgttttacataaaataatttcaaatttttgatcgcgcgcgtcacgcagcatccggttaaatgccggccgcgcgcggtcggcgccggaatagtcgtcgtcgcaataggccgcgtagacttcccatccgcgttccgccgcgtattcggtcaaaagggcgcgctggttttgtatgctctcgctttcccgcgtgccgtcgccgtcctcccggctcagacggcagtaaacggcgcacttcattgtatatccccatctgccgccagcccttcgctgagcatggcgcgcagatattcgtcgagcagcgcgccgatctgttcacaccgcgcctgttccccgtccgattgatagatgtctgtaattagcaaggccgtcttgtccgccatagtcgtccctgccgcattgtatgcgcaaagggaatcggatatgccccgggcgcgcgtgacctgttcgcgcgcgggccgtgcacaaaggcccaaaaaaaggaggaagcccacagccgctgtttgcggacggctgtgggccagacggagaaacccgatttgcaccggctgccagttcgcacccggcgcgaactgtgcggcgcggccggcattcgtggtcggctccgcggggtagggattggcgatcccgtttgcaagaaaaacgctgcccgtccatttcaccgccggcgaaacggcaaatggacacagacaagaaagaggagacgcccatgctgtgtgtgcacaacaccaggctttagtctgaccaaagggcacaatcaggagcaccgttttggccaaacattgagaggcaactcgttcccatgagcacatctcttagttagcattgactaactgtctatactttaccaccccaaaccaggtttgtcaataggatttttaaaattttttcgacgcgttgcggttgcatctttttttctgcatgctatactgaatttcagacgattcagatgggggattttgtcgtggaaaaaataaagtatacagcaagtgttcccgcttccaaggaggcgctgtgagccggcgccggcgccgcggacgcggcgggcaggttccgatacttccgtttctgtgcgcaggcggtataatttttgcggcttttttggtcgtcgtgctgctcaacgatgcgatgggcggtcagcttccgctgccgacggcggcgcagatcgaatcggccgctgcgggcgctttggacaagctgtacggcgccgcggatcttgtcccgcagccggtgcatgtggatggggaggtgtctgtccactttatagatgtgggacaagctgactgcgagctgatccaaacgccggaaagcaccgtcctgatcgatgcgggcgatattggcggcggggacgctgttgtggcatatctcaaggcgcagggcgtgaatcgaatcgatctgttaatcgcttcacatccgcatgccgatcatattggcgggatgaaggaagttgttgagacgttcgatataggaaagatcatcttttcggatgtacctgacgaactgattccaacgagcaaaacctatgaaggcctgattgacgccatcgccgcgcgcgggtataaaattacgaaagccaagccccgcgccgtctatgatctgggcggcggcgcgtcgctgacaattttggggccggtcgcccagtatgacgatttgaacgaaacctctgtcgcgtgccggtttgattttggaaagacttcgtttttatttacaggagacgctgaaaaggaaaatgaaaacgatcttgtggcggcgtatggctcggcgctcaaggcggacgtgttcaagctcggccaccatggaagcagcacatcgaatcagcagaagcttttgaacgcggtcgatcctgatattgccgtctgcgaggtgggatatgacaattcctatgggcacccgcatgctgagacgctcgaacggctcctaaagatgggggtcacgctctatcggaccgaccgcgacgggacagttgtcatcggctccgacggagagacgctgtctgttgcaacggaaaagtaacgggtgcggcgtttgttgcgactttatggacaaatgttgcatgatttctgtgaagcattgacacgcccgatgcatcgaattatactaaaatcaggcaaaagacaactatatcgttgctttaaaggagtgattgcacatggcaattttggtcacaggcggcgccggctatatcggttcccacacctgtgtggagctgctgaacgccggtaaggagattgtcgtcctcgataatttcgtcaattccaagccggaggcgcttaaacgcatcagcgacatcactggcaaatcgtttaaatcatatgaggttgatctgctcgaccgcgacggtgtgcgccgcgtgtttgaacagaatcagatcgacgcagtcatccatttcgccggtctgaaggctgttggtgaatcgtgcaaaattccgctgcgctattaccacaacaatatcaccggcacgctgatcctctgtgaggtaatggctggtgcgggctgcaaaaagatcgttttctcctcgtcggcgaccgtttatgggatgcacaatcaggtgccgtttcgcgaggacatgccgctgtcaacgacaaatccctatggtacgaccaagctgttcattgaacagattctcaccgatattcagaaggctgatccacagtggagcgtcgccctgctccgttacttcaatccgatcggcgcgcacaaaagcggcttgatcggcgaagacccgaacggcatcccaaacaacctgctgccgtatatcgcgcaggtcgcaaccggaaagctgcccgacctggcggtttatggagacgactatgatacgcccgacggcaccggcgtgcgcgactatatccatgtggtcgatctggcggttggccatctcaaggcgctcgattatattatgaaccgtaccggcgttgaggcgatcaatctcggaacgggcaagggatattcagtgctcgacgttgtccatgcatttgaaagagcgtgcggcaagccggtcaagtaccatattgcgccgcgtcgtgacggtgatatcgccacatcttacgccgatgcctccaaggcgaaggagctgctcggctggagcgcggagcacacgctcgacgagatgtgcgccgatagctggaatttcagtaaaaggaatccaaacggcctttaaggacacaaagcccgcgcgctggctaaagccggcgcgcgggcttctttgcctccgtgggcaggcttgcattttatagggaaaactgataaactaaaggtattcttgtagaaattgttacaaaacaaatgaaaaatcaggtgaggttttttatgcctaacacgcacaaaaaaaatattcatgccaaatcggttttcagcctgctgctgagcaagatggcaattggcgtcttgctgattttggtacagattgccatcctggtattgctggtattgtttttgagcgattacttcaccattgtctatggtgttttgtcgcttttaagcgtcggcattgcagtctggcttgtcagcaaaaatgaaaatccctcatataaacttgcctggatcatcccgatcatgctgtttccgttgttcgggggagtcttttatctgatgttcggcaaccagagcatgccgaaaaagctggtggaccgcattcgggaggcggaaaagagcgagcaccgtgtcgcgccgccggacgagccatgcgccggcgagctgatcacaaacgatccgcagcttgggctggtttccaattatatcacgcggacaaccggatcgccagtgtggaaaaacacgcaggcgcagtatctgccgatcggtgaaaccatgtgggcgcgcctgcgcgaggagctgccaaaggccaaacgctttatcttcatggaatattttatccttgaggaaggcgaaatgtgggaaccgatctttgagattctcaagcagaaggcggccgagggggttgaggtccgatttatgtacgacgacctcggctccattatgacgctgcctgtcaattacgacgttcaattgcgcaacgcgggcattcaatgcgcggtgttcaaccccttcaagccgcatctgaatgcgaccatgaattatcgcgatcaccgcaagatcactgtgattgacggcaatgtcggcttctgcggcgggatcaacatcgcggacgaatatatcaacgcgtacgaaaagcacggccattggaaggatacgggcgtgctgctgcgcggagacgccgtttggaacctgacggctatgtttttgtccctgtggaattttaccagcccgacggacaaacagtttgagcagtaccgtccgacaatccactgtgaaagcgacggctatgtacagccattcggcgattcgcctctcgatcatatcaatgtctccgaggagacatatatgcagattatcaaccgcgccacgcgttatgtttatattacgacgccgtacctcatccttgacaatgaaatgatcacggcgcttcaagtggcggcgcgcagcggcgttgatgtacgtatcgtcaccccgcacgttcccgacaagtggctggttcaccaaacgacgcagtccttttatcaggtattgctcgacgcgggcgtgcgcatctatgagtatacgcccggctttgtacatgccaaaatgtacgtatccgacgatacggtcgcgatcgtcggcacggccaatatggattaccgcagcttttatctccattttgaatgcggcgtttgttttttccggtcgagcgtggtgcaggatgtgcgtgccgatattgagcatttgctgacgcaatgctttgaaattccaaaggattatatccggcatgtgcgcctgtggaagcgtattgtccgcgcgtttttgcgcctgttctccccaatgatgtaggcgatgccggcccggccgtcttttgcgctccgctttcagggcggggcgcttttcatttaaaatattttgagtcgccatgggcctttctttcgttggatttttctggtacaatgtattaggtatacgagggctgaccagccggacagggggactgagcatggaacaaatgtatgatcttgcggtcattggggcgggaccaggcggttatacagccgcactgacagcggcaaagcttggtatgcgcgtcatcgtttttgaaaagcgggcgcttggaggcgcttgtttaaacatcggctgcatcccgacaaaggcgcttgcctgttcggcgtcgctgtatcagacatttcaaaattgcgcgtggtttggcctgtccgcgccgcagacaggcttcgattacgcaaaaatacacgcctataaggagctctgcgtttcacagtcgcgcgagaatatccgcgctcagtttgaggcggaaggcgtcgtttatattgagggcagggccgccgtcgcgggcgcgcgttcagtgcgcctcaccacggcggacggcgtacagcggatgtacaatgcgcgctatatcctgattgcatcgggcgcgcgcccaaacaggccgctgtttccgggcgtgctgctgccgggcgttgtgacaagcaccgacgttctgacagacagccagtggcattacgaccgggtggcagtcatcggcggcggcgtggtcggcgtcgagcttgcaaccatcctgggcgctctcggcgcgcatgtgacgattattgaaaagaaagaacgtctgcttgcgcccatggacggggagctgtccgccgcgcttgaaacgctgctgcgccgccgcggcatcgaagtgttgacaaacgcaaccgtcgagcgtgccgcagaaggggacggcgctctgacctgcacagtccggcaggggcaggagctgtcagcacgcacggttcagcgcgtgctggttgcagtcggacgcaaaccgtgtctcgaggggctgatcgatgataaagtgcccatccgcgcggacgaccggggcatcattgtagatgaaaacttcatgacaagcgtgcgcgggatctatgccgtcggcgatgtgctgggcggcgttcaattagcgcatctggcggccgcgcaggggatgcgcgtggtggagaagctgtgcggcaaaacgccgtcagtgatgctttcaaccgtgccgagctgtgcgtttgttgatcttccgatcgtgccgagctgtatttatatcgatccggagatcgcgtctgtcggcatcaccgagacggaggcgcgcaaaaacgggattgctgtgcgctgtggaaaatcggagatgagcggcaacggccgcgcgattatttcacatgaggaaagcgggttcatcaagctggtgtttgaagcgcacagccacatgctgatcggcgcgcagatgatgtgcccgcgcgccacagacatgatcggcgagatggcgaccgcgattgcaaatggattgaccgcgcgccagctccggtatgccatgcgtgcgcatcccacctttaacgagggtgtcgccaaagcaattctgcctatataaaaatatgtaaagggatcggatgtgcagcctgcgaaaatgcagtgcccgccccgctgttcgcggcgtagccgactaaagttttttggcatacctttttttcaaaaaaggtatgaagttttcgccgaagccttttttcaaaaaggctggagagagtcgaggcgggcgcgcaggttgataaaatcgtcgagcgcgccgggcttgttgacagggttgcgcagcagggcggcgggatgaaaggtacccatcatcataaggccgtccttatcaaagaattcgccgtgctggcgtgtgaccttgaaattcggatcgatcagcgcgcaggcggcgacgcgcccgaggcagacgatgatttttggccggatgaactcaatctgcgcgcgcagatatggcatacaggcttcgacctcgtcgcgttccgggtccctgtttttgggcgggcggcattttaccatattggtgatgtaaacgtcgttctgacgcgacagcccgacatgcgtcaaaatcttatcgagaagctgtcccgcgcgcccaacgaatggttcgccctgcaaatcctcgttttcacccggaccctccccgataaacataattttggcatgttggctgccagcgccaaaaacaacgctgtggcgcgtctggcacagcttgcagccctgacatgcaagcgcggcactttgcagcgcctgaaagctttcatacatggcggaacctccattttatccctaaattgtctttggccggacaacacccttttctttcccttgaaatggagcgcggtcatggctttgcttacagtttaattgtatcgggaacaaatgtcaaatcgttgattttttcgcaaaacgcttgaaaaaaatgcggacaaagcgtacaatggaactgtaccataatttcgcaattggaggattaaggatatggcaaatacgtttattgttgagacttctgcgcgtcatctgcatgtgacggagcaggacttggaaacgctgtttggcaagggtgcgaagctgcactataaaaaggagttgtcgcagcccggtcagtatgcctgcgaggaacgcgtcgatgtcgtcggcccgaaaaagacgatcaatatgtccattatcggaccgtgccgccccgcaacgcaggttgaggtcgctttgaccgatgcgcgcgcgctcggcctgacgccgccgatccgcgaatccggccatgttgagggcagcgccccgtgcaagctggtcggcccgtgcggtgaggtcgaattaaagcagggcgtgattgtcgccaagcgtcactgccactttgatccggcgtttgccgagcaggtgggggtcaaggacaaggacattgtgtccgttaaaatcaatacgcccgagcgttcgctcgtgttcggcgatgtggtgatccgtgtcagcccggcattccgtccggcgatgcatatcgataccgacgaagccaacgcggcgggctgcgcgggcgaggtgctcggcgaggttgtcaaataagcggtctagggcatataacagcgggacggcatgggtacatgccgtcccgctgagtattttcatttgccgggtatcgctattgtatcgggcgtcaaccgtgcggcagccgatcttttatcgccctgtcatggattccacacatttataacacaattttcctccatactgaaccacagcaagctgtgaaagggtgcacatcatggacaataaaattcttgtggcggaggatgaggaaaaaatccgccgtcttgtttcaagctaccttgtgcgcgagggttttaaggtggtggaggccgcagacggacagcaggctgtcgaaagatttgaggacaacgaggacgtcgtactggtgatgctcgatgtcatgatgccgaaaaaggacggttatgacgcctgccgagaaatacgcggcaaatcgaacgtgccgatcctgatgctgacggcgcgcgacagcgagcaggacgaggtggcagggttcggcgccggcgccgacgagtatatcgccaagccgttttctccgaccattctggtgacgcgcgtaaaaaaccttttgcgccgcaccagctccaacgatatgagcgacgtatcggccggcggcgtaaaggtgctttaccgggagcgcacagtgacagtcgacggcaaaaaaatcattacaacgcccaaggagttcgacctgctttattatttgatccgcaacacaaacattgttttgacacgcgaccagatcatctgcacggtctgggatatggattacgccggcgacgaccgaacggtcgatacacatatcaaatgcctgcgcgccaagctcggtccgtatgccaaatgcatcgtcaccgtgcgaaaggttggatataagtttgagtggctggaatgactggggcctcaagcgaaaactgtttgcaattatcctttttatactgattgtaaatattgttgtgctgctgtttatgggttccactctgtttgaacgcttttatatcggcaacaagcagacagagcttcagcgcagcgccgaaaaaatccgtgaaacctatgaacagagcagcgccgatttctatgatgaaattgaactgattgagaacgaaaacgccactgtgacgctgttcgagatcgattccaacggttcgcttgcagtcaaataccactcgcgcgccggcaaggatgagatgcgtccctggggcgacaagccggatatgcctgttccgcgcgatgatggcatggagcggtttaaaaaggatatgctggaccggctcctgcgcgcggacgacagctacaatatccgtgtggaggcgccgtttggccgtgacgatgtcgatggttcaattactttgacaacgcggctcgacgacaatctttacctgtttatggattccccgcgcggttatatcaaatcgagcgccgatctggctgtgaagtacacggcctttttgtccattattattttgctgatcggttcatggctgatctatctggccgttgaccgcatgacaaagcccatccgaaacatacaggaggtcgctgataaaatttcccgtctcgatttctcccagaactgtccggcgcgcggcagcgatgaaatcgcgcggcttgcaacctcaatcaacaacatgtcggatgaattgcagtcgaacatcagccgtttggtggaggccaacgatgtcctcaaaagcgacttggagcgccagcagcagacggaacagatgcgccggcagtttattgcgaatgtttcgcacgatttcaagacgcccctgaccctgatgatcagctatgcggaggcgctttctgaacaggcgcacggcgaacaggcgcaggaatgctgtgagatcattatcggcgaggggaacaagctgtctgcaatggtgggccggctgctcgagctgtcgcgccttgaaagcggcgtggcccgcgctgaaaaatcgatcttctgtttaagcgaggtgcttgacgaatctgtgcgcagcctgcgtattttgacagagccgcgcgggatacaggtgcgccgttgtctggatgaggaattcatcgtctgcgccgattataccaagattgaccaggttgtgacaaacctgtttgagaacgccgccaaatatgcgccaaagggagcggttgtcacgctgtgtgcgcagcgtgctggtgtggatgcgtgccgcgtatccgttgaaaacacgggtgcgcagattccgcaggaggatatcagcagcctgtttgacagcttttaccggggggataaggcgcggtccaacgatggacagagctatggtctggggcttgcaattgtgcgcggcattatggatgcacacggccgcccctacggtgtggaaaatatagaaggcggcgtgcggttctggtttgaactggagctggccgaccttgatgatacggacgatagcagtggggacatgccggaggagggaatataagcgctgaaaggcggcctgacacgatacgggccgcctttttttgttgcgatatcctccatggccagggcgatacgcaggcacagcccgccgccgccctgatggccaattttatcacgccgctttgcggacacgataaaaaggcgttcccctatggaattttgaatcttcctgcgctataataaaaccatataaaagacaaaagcggtgcagcatcaaagcgtgaaagtggtggtgggccgcaattatgaggtgtattatgcaggaacatcacggtgcgcgcggagcgcagtttggcagcaaaatcggctttattttggcctcggtcggttcggcgatcggtatgggaaacatctggatgtttccataccgcgtggggcagtatggcggggcggcgtttttaattccatattttctgtttgtggcgctgttcggcgcagtcggactttcgggtgaatttgcacttggacgtctgacggggacaggaccagtcgggtcctatgattatgcaatgcgcacgcgcggtttgcgcggcggaaaattgctcggtgcgattccgctgctcggttcgttcgggattgcaattggctattctgtcattgtcggctgggtgctgcgttcggccgccggcgccgcgacgggcgggctgttcgcggccgattccgaaacgtttttttcgcagatgacaggcaggtttggaagcgttccgtggcatctggcggttgtggcgctgacggtgctgtttttagcgggcggcgtcatcaaggggattgaaaaagccaaccgtgttatgatgccggcgttttttgtgttgtttatcatcattgcggtacgtgtcgcattcctgccgggcgcgggggagggataccgttatttgtttgttcccaagtggagcgccctgcttgatatgcgcacctggattatggcgatgggacaggcgtttttctccctgtcgatcaccggctccggaatgattatctatggcagttatctggctaaaacagaggatatcccccatgcgtccgcgatgacggccatcctcgacacgctggccgcgctggtcgcgggctttgcggtgatcccggctgtttatgcgtttggccttgacccgcgctccggcccgccgctgattttcctgacgcttcccaaggttttcgcgcagatgcctgccgggaggctgtttgcggcgctgttttttatatcggtattttttgcgggcattacctcgctgatcaacatgctggaggtgtgcggcgaggcgctcagccgccatctgcgccttggacgcctgcccgccctgcttataacgggcgcgattgtgttcggcgcgggcctgtttattgaatatgagccgtatctcggccgatggatggatgtggtcacgatctatatcgtgcccatcggcgcgctgctcggcgcagtcatgatctattgggtgcttggtatggacaacatcggcagggagctgatgacaggccgcaaaaagccgcttctgcatggctttgcatttctggcaaaatacgtctatatttttctggcgggcgctgtggtcgtatgcagctttacaatcaagggaggcatcggctgatgcggcttgcggcgattgcctgccgtgttttcacgcgtgaattgagcgcggccgtcgccaaatgcccgcatccggtggaggtcagttggctgccgcaggggttgcacgatacgccagatttgctgcgcgcgcggattaacaggacaattgacgcaatcgaacgcgccgacgccggagcgcccgcccgccgccggctggatgcgattgtgctttgttacggcctttgcggcggcgggcttgacggtgtgcgcgcgggccggctgccgctggttgtgccgcgcgccgacgattgtatcgggatattgcttggctctcaaaagcggtatcttgattatctcgccgcacgcgccggcatttactggtatacgccgggatggattgaatatgcggacacgccctcgcgcgtctattatgatgcaaagctgcgcgactataccgcgcggttcggcgcggagaacgcgcaatggctgctggagcaggaaaatacctggatcggcgcctatgagagcggtatttatattgcgccgcccgcctgcccttccggcgcgtttgaagcgttcgcacaggatgctgcgcgcatgtatggctggcgttatgagtcggttttgggcagcgccggctggctggaggctctgctttccggcggctgggatgcgcgccgttttgccgtctgcccgcccggcgaaaccctatcccgcacctacgacccgcagattttcccgcttttttgaaaaaagcttgcaaaaaactttccggcttttttgaaaaaaagcctcggcaaaaaactttagtcggctgcgccgcgaacagcgggacaggtttcggcatttatgcaggctgcgccgcgaacagcggggcgtgtgcgtttcctatgggtacaatttcttatattgcggtgcgccggcatggggcggcgtaccatccgcaatcgaggttttgatatcaggcaggattacgccatcgagcgaatcggcgtccgatgaacagtggatcaattcgacctgcccgcagcggtccgccgcaaaatcagccacccgcttcatcagcgtcgattttccggcgcccggaccgcccttgatgacaaattcacgccatccatccgttggatcagcgagctggtcaaagcgggagacgaagccctgaggcgtgtttgctccaagaaaaaagcgcaggggctttgcggtatcactcatataaagacccattcctttcgcatcttgatgaaagccgcggacggccggcgcgaagctgccgcgccttttttaccgcgcgtttttctgcgtgcaccgcccaaaacagccgttatatcatcgtattcccttccgtgcaatttggttcgtcggaaaaatcgaagaaaacagaaacgcaaaagtttgttaagccgcggggagcggacagcagaaatgctgtccgctctttttttctccataagcgtccgaaagtgcctctgtatgaatgcgcaattctcacaaattttagaaggaaagcttgtttatgtggatgaaattggatgtttaggcaatatttaattgacttttgtattagcaaactatataatatcgacatagcgaacaactgaataaatgaaacagcgaaaaagaagggagatggagatgtgaaaattataaaggtcgaggtatttcgacttccgaccgccaacagcaggcaaaacagtccgattggctgccgggtctatacggatgcgggaatttacggcgacggcgaagctggtatggcctatggcgtgggcggctccgcagcgtttggaatggtgtgcgatctggcggagcttgtcatcgggatggacccgcttgggacagagctgatctgggagacaatgtataaaaaaaccttctggggccagaacggcggaccggtcgtcttttccgggatcgccgcgatcgatgtggccctgtgggatatcaaggggaaatatttcaaggttccggtctatcagcttttgggcggcaaggtgcgcagccggctgcgcacctatgcaagccagctccagtttggctggggccgggtgggtgtcagcgaacacctgtgggcggtgactccagaggattatgcccacaatgtcaagctggcggtcgccgaaggctttgacgctgtcaagatcgacttttttgaccgcgatgaacagggcaggccgcttaacttcctggatacgaccggatttttgacgcccaaacagctcaagatggtggaggcccgcatgaaggctgcgcgggacgcggccggggacgaagtggacatcattatggaaaaccattccttccctgacgcgcagtccgccgtacagctcggccgggcgcttgagaaatacaacatcttctattttgaggagccgaacaccccgacgcccaagacggccaagtttatttccgataagctgtccatgccgatttcacacggtgaacgcgtctattcccgctggcagtacgcgccctattttgaaaacatgtccgtccaggtgattcagcctgatcttggcaactgcggcggcatcaccgaaggcaagaaaatctgcgatatggcctatacatacgatatttccgtccaggcgcatgtctgtgcttcgccgctgtcgaccgccgccgcgcttcacctggaatgcgtgatccccaattttgtaattcatgaacatcatcagatcaacctggaggaatataacaaacgtctgtgcaccgtagatttccagccagtcaacggcaaattcaaggtgcccgagggtccgggactgggcgctgaaatcagcgaatgggccttgaccgaaggcgtggatatgaaagtcacggtcgaataacgccgtttcatacggattagccacgcggcgcgcgccgccgtaaaaaatccaagtccgccgcgccggaaaaccgacgcccaagaaaagggcgcccttttcttgtcttgcgcaattgcgcaagacaagaaaagggcgcccttttcttgtcttgcgcaattgcgcaagacaattccctctgtaccgccggacagaaggcgcggcgggccgtatccccatacggcggggaatcgaacggcagagagaaattcaaacatattggaggtttcgtttatggcaatcaaagttgttcatgaaccagagccgaagcccggcagtctgggaaagcctgaactttatgcgctggccatcggccaggtgatcggcgccggcgtcatcacccttattgtcccggcgatcaaaatgactggatactccgcctggctggcatactttgcggcgatcatcatgggctttgttatgatcctgcccacggtttttgtttcctccacggtccgcatgggcggcggcaattattcgatgctctgcggcctggctggtcccaatattgcaggcatctatgctttctcttatctgacgcagtgtttgtctctctcgttgttcggcgcttcggccgctgcctatctgggtgacatcattccggcgttgagcggccatttgccgcgcgtcattgtgggcgccgccctgctgacgtttttctttgtggtcaatctgatgggaatcgatatcatggcgtcggcgcaaaagctgatgacctggctgctgattgcggcgctgatcctttttgccgttgtcggcatcgccaggatgaagctgccgattttcgatttttccgatcccaatttcctgattaacggatggggcatcacctttgagaacgggcagatttccggcggatttatcggcgcgacgcttctgttcgtttattccacgcagggctattatatgacgacggcttacggcggggactccaaaaacgcgcgccgcgacatcccgattgttttgctgcttgccgtccccacactgatcgtcctttatgtgggcgtggccatggccggcgtgggcgtcatgaccgtggaggaatacggcgcttccacaacgctcgtgttcgccgcgcagcgcatcttcccgacagttctgttctatgcctttatcatcggcggtcctatcatggcgctgctttccacgctgaattccagctttgcgtataacgccatcaccatcggccagtcatgcgacgacggctggctgccgaaagcgttcggcaaaaagaacgcgaaagggtcccgtgtctggatactcacctttatgtatgtcgtgggcatgatcccaatcgtattcggcctgtcgatcacggtcatcaccaacatggtgcagctcatcggcgcgtgcttcgcctttcttaattttgtcgcgtatatcaaaatgccgaagctctatccgaatgcgtggaaaaagtcgcgattccatatccccgacggcctgtactatctgatctgctgcatatcgctcgcgggctttatcgtgacgctgtggaaatcctgcctgtccatgagtcccggcctagctgcggccaacgtggctgctatcgttgtgctggcgatcatcgggatcgttcgcggcaggaagggcgagatcgaagtacatacgtccatctggtccggcgacgcggccgaggatgcggccgccgcggccgtcggtcaaaaatgacaggcgctcatgcgctctgtcctgtataaatcatatggctttaaaacaatttgaaaacaagcaggaaaggaagacgattgtatgaaaatcacaagcgtggaatgctatctggcggacggcggattgggcggtttcgttaccgtaaaggtaaataccgacgagggcatcagcggctttggcgaggcgggtcttgcctatggaaagtgttccgaggcggcgttcggccagtgtcaggattttgccaaaatggtcatcggcatggacccgtttaacaccgaggaaatatgggagcatctgcaccgccacaccttctgggggatgggcggcggcgtggtggtgacttccgccatggcggccatcgacacagcttgctgggatatcaagggcaaggcgctcaatgttccggtttacaagcttatcggcggcaagacaaacaagaagctgcgcgcttatgccagccagctccagttcggctggcgcacgctgatcgagaaaaacgacgcgctgacgctgctgtatgatccgcaggattattacgatgtggtgaaggacgctgtggccgaaggttacgacgccgtgaagatcgaccccgtattcgctccgctggaggatgcgggcatggccccctttgccacacagggcaaccagatccgcggatgctaccgcgagcacgacctgaaacgttcggtcgagcgtatcgccgccgcgcgtgaggcaggcggaccggaccttgacatcattgtggaaatccattcgcttctggacgccaacaccgcggcgatcctgggcaaggcgttggagccttaccgcatcatgtactatgaggagccgactatgccctgcaatccggacgtattcaagcacatcaaaagccgctgctccctgcctttggccactggagagcgcagctatacgcgctggggattccgccagttctttgaggaccggacgctggatgtgatccagcccgatctggccaataccggcggcatcactgagacaaagaaaatctgcgatatggcgcaggtgtacgacgtcggcgttcaaatccatgtgtgcggcggcccgatcgctacggcggcggcccttcaggtcgaagcggccatcccgaactttgtcatccacgaggagcacaacgccaatctgctcaaggtctttaaggaggccggaaagtactatcacgcgccggtcaacggcttctatgatgtcccggagctgcccggcatcggccaggagatgagcgaaaaggccatggccaccgcccgcagggttgttattgagtaatcccttcccccacaatgatcgcctcctccgtccttcggcgggggaggcgattcattttcagccccggatacgggcgaagatgagaggagatgaggttttatggagctgctgaaattagcgggcgtattctgtgtgatgattttagtcctttggcggaaaaagccgctgtcctgggcggttgccgccgcggcccttgcggtctggctgctcttttggatgcccgcgcgcacattcgcggcggctttggtgcgcggcgcggtcagatgggataccattcaactgctgctggtgctttatctgattacattccttcaaaggatgcttgaaaagcgcggatgcctgacgagcgccaaggacgcgctggacgggctgttcaacagccggcgcgtcgacgcctccgcggcccccgcgctgctggggatgctgccggccgtgggtaccgtgctgatctgcggcgatatcgtccgccagagcacggacggctttttaaagacagaggaacaggcgtgtgtgacctcctattaccgccatgtttccgagctgttttttccaacctatacctccatcctcatcgccgtcgatctttcagcgggcaaggtgagcgttggcggatttacactggcgatgctgcccatgctggcggtgctgatggcgattggctggctgttttacctgcgcaggattccaaaggacgccggcttttttgccggacggcccaaggctttttattggaagctgctgttaaggtcgctttggacgatcatctttacggtgatcctgattgtggcgttcggcgtaccggtacacattgcggtgctggcctgtattgtctgcaacctgtttgtcggaagatttggctggaaggagcttcgtccctttttcgcctcggcttttgaagcgcgtctgatgatcagcacgctgctgattatgatgttcaaggaggtgctggccgccgcgggcgtgatcagcgcgctgcccgcctttttttcatcgctgccggttccgccgtttttggtctttgcgctgatttttttctttggcagcgtcgcggcgggcagccaagcgatcattgtgctgtgtatgggcatggctatggcggctgcggcgcagggcgggctggccctgtttgtgctgctgatgtgtatggcatacgcagccatgcagctttctccggttcatgtgtgtctggctgtctgcgcggaggattaccgcatctccctggggacgctgatccgcaaaaccgttccgctggtcggcgtattctgtctggcagcgtttggctactatgggcttctgcggctgttcggattttaactcaggcgtgaaaataaaaagcatatcgcaaaaagagggtgcaactgctgaaaaactggtgtataataaaaatacagacgaaagcgatcagcagggatccttttgactgttcagatactaattgattaggtgtggatatgctatggagaaaaagacgcctgccggccgcagaatgaagattgtcaaggtatccattgtggatcaggtctgcgacgccgtcaaaaaggatattatgaacgggacatggaaggcgggagagaagattccatctgagtccgagctggccgaacagttcggagtcaaccgtttgagcgtgcgcatggcccttcaaaagctgaatacgctgggtttgatcgagacgcgcgttggcgaggggtcgtttgtccgggatttttcgctgggcccctttttgtcggaaatttcctttatctattcctccgacgagaagtatcgggaggtccgccaattgcgtgagctcttggagggtgacagcattaatatcgccattcaatcggcgacgcaggaagaaatagacgaactgaaacgggcgctggatctctactttgaacaggcgaagcggtatcatcagaatatcgacagcgaggaggagctggaacggctggtggacgccgattttaatttccattacaagctggttaaaatgagccgcaacagtctgtataaggatgtgtactatatggttcagcagttgatccgccagcatatcagcaaacttgtctatatccgcacgcatgaggcgggatgggcgccgcaggagcagcatgacacgcatctgaaggtatttaacagcatcgttaacgccgatccggacgcggcccgtcaggccaaccgggagatgctcggcatcgtcccgattgccggcgtggaggaaaaggttcctctcgattggtagacggatgcactgcaaaagctcccgtgtcgcggtaccgtgacacgggagcctttcttcattgtttcaatcagccgaatgggtgctcaatgcgcgcccgcaggctgtcgggcagacgttcgagcggaaccagcgtcgagccggcgctcgcatcgtcgaaccacagggtcacatatgcgacaggttcgccgtaaacccagcgcgggacggcggcctgcataaggacctgaatatcatccggatcctcaaacagggaaagcttcgagctgttcaggctctgcgcctgctcagcggagccggcaggcgcagccgtatccgctgaacgccgcagctcgtcgaccagagccttgaactccgcgtaattttcagtgacgccgacggcgttatatgtctggatatacgcgccgctgccccctgcgaacaccgtctcggcaacgacgcctgccgcaatacaccgcacaggatcggctgctatttcatcaagcacgcccttttcgcgcaaaaaacgcagcgtattcggcgttttgtcagtgaccgcgaacgcgccgctgctggaaaaacgttcggcgccctcgggcgggaagtcggcgagaaactgaagattggcgatcaaggcgccctgcgggcgcgcgatttcctcggttgtccgggcaagaaggtcggcctgcatggcgtcaaagagcgcctgtgaatcagccgccggccagctcttttggacatatttgctgtcgtacgcgttggagatggtccatgaggtcacgtcgctgccgcggttaaagaatgcaggctgcgtctgtgcgagaaactcaggctgcgtctccagtgggagcagctccaaaaaggcgctgacgctcgcgccgtaatagctgcgcttgaccgtctgtccgtttttaaggcggtaggtgatatttgtatacccgtatacatacggatcgtcctccggccaggaatccgcgctgcgttccccctgttcgacgatcctctggtgaaacgagagcacacaatcgatatcctgcggctctttgagcagaacagagccgacgtactccgtttgaagcgcggcgggattgtcaaacggtttcacacgcaaaacgctggaccactcgccgtcgacgccgttgtagctgatttcaacggccgataccccgccggcgtcaggcacgcgccgttcatacccaagaccgccggtgatcgggatcaaagtcagaagggtgacggcggccgtcatcgcggcgccggccggcaatcgcctgacaagcgttttaaagccgcggttcagcacagcttccaataccagataagtgagaaggccggcgattgcggtccacatcaccgtgtatggagcggcgcgctccgggtcctgcacaagataggtgaacagtccggccataccgccgcagacggccacgccgaacagcttgacgatgaactggagcacgccgcgggaagcagtcgtttcggcgatttccgtgcggcgcacacggtagagccggcgggccgccagcaggacgagcgcgccgatggcgagccagaccagtagggccacgccgcttttggccgccatacggccctgttcaggtccatacgtcataccgtcaaggatgcgcatgaccgcgagcgtaaccggcgagaggtagcccggtacgcgtatcccgccgccgctccagccaaacagaaacgagtctgccagcgccagcccgatccaggacacggccggcggcgcgacgagcagcgccccggagaagataaaggagtcgaacaccgtgccggtgcagacgcagacgaatgttgttacagcgtagatggcaaaggtacagacaagccatccgaacaggtcgagcagtaaaaagaacaggtggcttgggtccggcccaaaccggatcgcctgcatcacgccgacgagcagtgtagatcctgccagggggacagcgatgattgtcatggctgtcgccgcatggaccatcagcagcgtgccgcgtgtgactggcagcgcatgatagacatccgccgcttttttcgaatgcatatagctgttgaaggcgagcgccagtacaagcggcgcaagcaggacaatgggcgtgagaatcaggcctgtcaggatcgtataattttcagcgaaaccatacaggtgataattggtgaggttggcggcgtttgcgtccgcgcgcagtggtttgaacgcctccagagcgtactggagcggataaaagacggcgatgagcgccgaaagcagatacatatagccgcggctgcgacgcagagtcatgcggtacaggccgaaaaaacggccggactcagaaaagaatgctgttgtagtcataaccgaccgcctccatttcatggataaatacttcctcaagcgtcagcgggacgccctcggcaaacacggcgccctgcgcgagcagaaagtcggcggcgctgtccgaggagccgcgcaccaccaggctgatcatgctgccgctgcgggaggactgcaaaacgtcaagcccgcgcagcgtctcgtcgctgacgccctgcgggaatactgcctgcactttacaaaagccgagacgcagctcgtcaatttcgcgctcgaacaggatatgaccccggtgcagcaggccgacgtgatcgcacagatcctccagttcacgcagattatggcttgtgatgagcacagtcatcccatattcggccacgccgtcggagagaagcctgcgcgccgcgccgcgcgcgaccggatcaaggccgtcgaacgcctcgtcaagcagcagcagcttcgggcggcaggcaagcgccagcacaagcgccgcctgacgcttcatcccctttgaaaacgtcgccagtttcgcggccggatcgagcggaaacacgccgagcaggcgttcaaaccgctcctgtgaataaccggggtaggattgggcataaaagcgcgccatatcgcgcaggctgctctgcggcagaaaatacaaatcgtccgcgataaaaaagaccgtctgcttgaccgcggtattttcatagactttctgtccgtcgacggcaatgctgccgccgtccggcatatagacgcccgcgcagagccgtaaaaacgtcgacttgcccgaaccattggagccgacaagtccatagacgctgccgcgcgggatacttgtggtcagagatgaaagcgcggtgaagtcgccgaagcatttgacaaggttttgcgcctctatcatacgttcgcctccttatagacatattcgaccgtttcaagcgcctgtgcgcgtgagacgccggcgcgccggccgctttcgagcgcgtcgcggattttctccaggctgcgcatgcgcagcgtctcgccggcgctgtcgccgccggcgatgaaactccccttgccggccacggaacagatgacgccgcggcgctccagttcctggtaagccttttggacagtattgggattgatgcccagatcgcgcgccagcgcgcgcacggatggaagctgctcgcccggtgcgagcgcgccaagcgccacaagctccgacatgcggtaaataagctgctcatagatcggctggcggctttgcaggtcgatggtcagcacgctgctgtcctcccttcgatcgattgtatgcagtgtactatatcaattagtacggtttgagtataccacaccccgcacgccgttgcaaccacttttttcatatggcagaggatcctttttaaagcttttatgaattttttccaataggtttgacagccgtgaaaatgatggtatactttaaaaagataattggcaaattgatttccttttccatgatgcgccccgcttgaagcggcgcatggggagggtgtaaggttggattttcatatgagaaaaacaaaaattgtctgtacgctcggccctgcttccgacagcgaggaacgcatcgcgcagcttatcagcgcgggcatgaacgtggcgcgcttcaatttttcgcacggcacgcatgaaagccatcgcgccacctttgaacgcatctgccggctgcgcgatcagatgggcgtccccgtggccacgctgctcgatacgaaggggcctgagatcaggctcggtctttttaagggcggaaaagcgcagcttgacgcgggaagccgcttcacgctgtgcactggggagtgcgagggcgattcttcacatgcgtcgatcaccttcccggggctggccgcggatgttaaggcgggcagtacgattctgctcaacgacggcgcgattgagctgcgcgtcgcgggggtgcgcgagggcgccatcgaatgcgatgttgtcaacggcggcgttatctccgatcataagggcgtcaacgttcccggaatccatctgtcaatgccatatgtcagcgagcgcgaccgcgcggatatcatgttcggcgccgagatgggattcgattttatcgcggcttcgtttgtgcgctgcgccgatgatatcctccagatccgtcagatcctggagcgtcagggcaatgaaaaaatccgcatcattgcaaagatcgaaaacgccgagggcgttggcaacatcgacgacatcctgcgcgtcagcgacggcattatggtcgcgcgcggcgatatgggcgtcgaggttccgtttgaggaggtccccatccttcaaaagatgctgatctccaagtgctataacacaggtaagatggtcatcacggcgacgcagatgctggagagcatgattcataacccccgccccaccagagccgaggcggccgacgtggccaatgcgatctatgacgggacaagcgcgattatgctttcaggggaaacagccgccggcgattatccgatcgaggctgtttccacaatggcgcagatcgccgagcgcaccgagcgcgacatcaactatcaaaagcggtttttcgcccgctcgggcgagcgcgtgcccgatatcacaaacgcgatttcacacgcgacctgtacaacggcttatgatttgggcgcggcggcgatcattacagtcacctggtccgggacgacggcccgtatgctctccaagttcaggccggatatcccgattattgcctgcacgcatatgccgcacacatatcaccagctcgcgctgtcatggggcgtcacgccgctgttggctgacgttaagcagagcacggacgatctgttcgctcatgcggtggaacgcgcccaggccgccggttttgtgcgcgacggcgatattgtcgtaatcacggcgggcgtcccgctgggaattaacggcacgaccaatctgctgaaggtacatgttgtgggcgacatccttgtaagcgggcagggcgtcaacgggcgctgcgcgttcggcagactgtgcgtcgcgcgcaccggcgaggaggcgcttgcgtcttttaatgacggagatatcctggtggtgccgcagacttcaaacgagctgttgcccatcatgaaaaaagcatccggcatcgtaactgaacgcggcgggcttaattcgcacgcggcaatcgtcggcatggcgcttgatatcccggtgattgtgtttgcggaaaatgcgacctcgatcctcaaatcgtctacggtcgttgaaatcgacgcggccgccggtaccgtcagcaaccgcacacgtacggagcgggacggacagaaaaagggataatagccctgcggcctgttgccgtgcgtaagcaggctttcaggccggggcatatggaaaaaacatagggcgcgctgtaaaatagtccgctgcgcccagtataaaggagttcaggctatgaaacaagtacatgcacagaaccgtttgattgcgctgctgctggctgtgaccatgctcctgtcggccgcggcgtgtggaggccgtgagacttctccggatgcaagcagttcgacaccgcaggacacatcgtcaacaggtgtgcccgcatttgtcaacccgctcccggacgccgatctgtctgcggtcgcggagcctaaaaagcccgagggcgatcttcttgaaaagctcaacaccgcctacaaccaaaacaacgatgttgttggctggctcagtgtgcccgatacaacgatggacgatcctgtcatgttctgcgaaaacgacgccaacacacaaaacgatccagacccggagaacagaaacttttatcagcgccgcgatatcaacaagcagtacgattggtacggctcttattgggttgattatgagtgcaagctcggcaaccgcaaccagctttcgcgcaacacgatcatctacggccacagcatggacgatgatccggaagggctgaagatgtcgcagcttaaaaagtataatgatattgagtgggcaaaacagcatccgtacatttacttctcgactgctgaggacgaaatggtgtggaaggtgtttgctgtttcaactgtcgatacaaaccttgcttacaaccatcccgacttgtccgacgccgattttatgaatctgatttcagagctgaaggaccgctccgtctatgatatcgatgtggacgtcaagtcgaccgataagattctgctgatctccacctgtacatatccgacaaactatacaaacgtccagctcgacgagagtacaaagtatctgatcgtcgcgcgcctgctgcgtcccggcgaggaggaaacggccaccgttgagatgaccgtcaacgaggatgtgaagaagccgcagtacaatttctgatctccgctctcttgtgggatcggtacggataaaataaaaaagcaggccgcgtccagcgcggcctgcttttttgttcagcggcggatattgcggccctttggggtttggccgggccgcggcgctttcggccgccggctcgttttgtctggcgcgggcgcggtgcgggccagcccgaagaaggcgaacaagtccgtgcggccggcgcggcgcagcgccgtctcgaccagacggcggttttcaggcttataatattgcaacagcgcgcgctgcagctttttgtcctccggggcgcgcggcacaaagacctctttgagcgtgtaggggtcaagtccggtgtagaacatgcaggtcgagatgctgccgggcgtgggataaaagtcctgcacctgttccggacggatgcggtgttttttgagaaacaccgccagattaaccgcgtcgcgcagcgtcgaaccgggatgggaggaaatcagataggggacaaggtactgttccttgccgatctgtttggtcaggcggtaaaagcggtcggcgaattgttcgtagacctcgatatgcggctttcccatgcagtcgagcacatgcgcgctgcaatgctccggggcgaccttgagctggccgcttacatggtgctggagcagttcgcgcataaaggtgtcgtccttctcgagcatcatatagtcatagcgaaggccggaacgcacaaatacacggcggacgcccggaatttcccgcagctcgcgcaggatggagagatattccgcatggtcggcgcgcagcgccgggcacggcttgggcgcgaggcatttgcggtcggcgcaaagccctttggtgagctgcttttgacaggagggatggcggaagttggccgacgggccgccgacgtcgctgatgatgcctttaaagcgcgggtttttgacaaagcgtttggcctccgcgacaacggattcacggctgcggcaggtgacggcgcgcccctgatggaaggcgatggagcagaagttgcagccgccgaagcagccgcggttgtgcataattgagaattctacctccttgatcgcgtcgacgccgccctgagcctcgtaagagggatgatacatgcgttcgaagggcagggcgaatacagcgtcaagctcctcagtggtgagcggcggcatcggttcggtctgaacaagaaatacctcgtcggactgcttttggatgattttgcgtccgcgcacagcgtcctgttcgtccatgagcgtgcgcgtcgctttggcaaaagagagcttattgtcgcgcaccttggcgtaagaggcgactgatacggcgtctgtgggcaaatcaagctgatttgtgagatagcagacgccgcggcagcgaatcgcgcgcgccggcacgccgtccgcaagggcgcgcgcgatcagctccgtctgcttttcacccatgccgtaaatgagcagatcggcgccgctgtccacaagaatggagggcatgaccgtatcggaccagtagtcgtagtgcgcgaaacggcgcatggaggattcaagtccgccggtcacaatctgcgcgtccggatacagcgcacggattctgcggcagtagacggtcaccgcgcggtcgggccggcggcccgcgcggccgccgggcgtgtaggcgtcgtcagaacggcgccgtttggccgctgtataatgcgcgaccatggaatcgatgttgccgcccgtcacccaccagccgtattttggcgcgccaaaacgcatgtagtcgctgtctgtaacaggctgtgcgatcatggcgacccgatagccgagcgattccagcaggcgcgatacgatggcaatcccaaagcttggatgatcgacatatgcgtcgccggttacacagatgaaatcgggccgctcccaaccgcgcgcctgcatttcctgcggcgtcaggggtaaaaacataaacgtcctccttaaaaaacggccgccgcgtatgcggcggccctgcctgtatatggtcggaattattcctggcggttcagcttcatttcagcccagcgttccggagaaataagcacctgacgcggcttgctgccctcgaacgggccgacgatgccgcgcgattccatctcgtcgacaatccgcgcggcgcgcgcatagccgagcttgagacgccgctgcaaaagcgaagtcgacgccatgccggcttccacgacgcattcaatcgcgggcatgagcatttcatcctcgccgctgtcggcatccgcgttttcagaggccgcgccgccacccttggagccttttccagcgacaacatggctgtcgatttcctgcacgattgattcgtcatatgcggcggacgaatcgttcttgataaacgatacgacgctttcaatctcctcgtcggtgacaaagcagccctgcacgcggatcggtttgggagcgccgaccgggctgaacagcatatcgccccggccaagcagcttttccgcgccgcccatatcgagaatggtgcgcgagtcgacctgcgaggacacggcaaaggcgatgcgggaagggatatttgccttgatgacgccggtgatgacgtcgacggaggggcgctgcgtcgcgataatcagatgcataccggctgcgcgcgccatctgcgccagacggcagatataatcctcaatttcgttcggcgcagccatcatcaaatcggccaactcgtcgatgatgatgacgacctgcggcattttttccataccttcagtacgttcggcaaggtggttaaacgatttcaagtcgcgcacggagttatcggcaaacagcttataacgcttgagcatctcggtaacagcccatgacagcgcgccggcggcttttttcggatcggtcacaaccggaacgagcaattgcgggatgccgttataaacgccaagctcgacgacttttggatcgatcatcagaaaacggacctcgtccggcgtcgaattaaagagcagggaaataatgatggaattgatgcacaccgattttccggagccggtcgagccggcgatcagcaggtgcggcatttttccgatgtcggcaaccgtgacattgcctgcgatatcgcgtccgagtgcaacagacagcttgcttttcgcttcggaaaattcgcgcgcgtcaaggatttcacggatggaaacggcgctcacgaccttattgggcacctcgatgccgacggcggccttattgggaatcggcgcttcgatgcgcacgcccgccgaggcgaggttgagggcgatgtcgtcggcaagcccggtaatccggctgattttgactccggccgacggctgaagctcataccgtgtgaccgccgggccgcgtgagatatcgacgatgcgcgtctgcacgccgaatgacgcgagcgtgtcgacgagacgctgcgcattcgccttcatctcctctgtgacatccgattcgcttgtacggcgcgcctcatgaagcagggagagcggcggcttgcgataggtcggcggtacgggctgcggatccggttcggcgggagggtccgggacatgcgcctgttcctgccccggctcgtcccatagagcagcatccggggccggctcctcaggcatgacgtcaggtttatccggtggatcgtcgagaatcggcggcagattgatgaccgtaccggacacggcgccgctgtgcggctcctttggcatggtgaagctgtcgaaggagggcgtttcttcagcggagaaggaaaaacgccccgtatcggtcgcagcctttgtcacaagctcgtcgatcgacggctcaggagcggcgacaaactgcattgcctcgtcggccggcatcagggagaatccggattcccgtgccgggtcgaacggctcgtcaagcgggatatcaatcgacggctttggatggtgcggagcatccgcacgcgccgccgctgccggagcctgcggctccgagtccgcctcggcggacggctccggcgtggccggagccagcgcggcgcccgtgcggttttcgccctcaagcggaatatcgatgcgcgcctgcctgcgctggcgcgcaggctttggcggcgcggccgcgcgggcggcgcgccgctgctcctggcgctccatctggtcggcgtacgtctcgccgatcttctgcacgggcttatgcgccgcctggacgatgccgatcagcgtgccgccggtcgtcagcatcaggaacacgaagatcagaagcacgatgataatacccgcgccgagcttgccgcagaacttgagcagtggcacgccaaccagcgctccgaccaggccgccgcttttgacgtcgatgcccgccacaatacattcaacaagcatttcaaggatgttttcatcagcggactgcggcatacccatcacaaagatttgaagcgacgcgcagaaaaaaagaattaaaaatccgcccatccaggcgcgtcccttgacaggcttgtccatcgtaagcaatgccgctatgtagatcagcaggacgcacacaaagattgcgccccagccgaacagaccaaacagggcgttgtgaagccaattccaggcgcttgcgccagaaacgagcgtcagcgcgccgaccagcacgccgactgcaaacaggattacagcctgcatctggcgtttagcgcgcttttgagcggcattgcgcttgcgcgcagcggcgctgccgcctttgccacgcgaacctgattttggttttgttgccatgataacctcctcaaaacacggactgttggcaagctcaggcatttcgccgacagccaaagggtagaagccggttttgactcagccgattaaaaactgctgaatcgcatggccggtaaaattgtcaattgttccaatgatgagtacaaccgtgccgagagcaagcgtataccagccgaaataacgcagcttattgcccttgacgacccattggaccagtttgatggccagcacgccgaataccgcagagctgatcaagccggtcaggatcacaggcagcgggagcgtcgtcccttcggaaacggcgtcagggatttcgagcacgatcgcgccgagcacggcgggaataccgagaataaacgaataagacacagcgaattcacggcgcagtccccacagcataccggtgcagatggtcgagcctgaacgcgaaatgcccggcattgtcgccacaacctgggccacgccaacagcaaccgcatccttcgccttcatattggaagcatccttgcgtccgcggtcgtgacgcgaggcccaggtcagcaggatgccggtgaacaggaaacagagtccctccacggtgatgtcattgtctgtggaaaacgcggagatgcgatccttgatgagcaccatcaaaaacaatgggcagacagacaacagcaaaaacagaagcatacgccgctcgggacgcatatcgcgtgtggagaagcggcgtgaaaaaagatcgccgatcagagaaaacgcttcggcgatcaggctgacgatcgtccgccagaatacgatacatacagcgatcagcgtaccggcgtgcagcaggatggaaaagacaaagcctgtttcgctgttgttgccggtgaaatactgaaacagggagagatgtcctgaactggaaacaggcagaaattccgtcagtccctgaatcaacccctgaaaaaacgcttcaaaaacactcataattggactccttatgtatggggcgccgcgggcgtcccgttattcctgttttgcaatacgccccccgggggcatagcgcggatcaagatacatttttggatcggtggagatcagccgcgaaatagtaaatactccattcatatttacgccctgtataaaattgttatgcatacggcgacattcgccgccccggggcgcatcgccgggaaagatctgctcgggcggaatgattgtatgcaggatcatttgacatcaccctcgatcatctcataaagcgccgcaatgacatcggacacgccgccgagcgaatcgatcagcccttcgtccacagccgcctggccgtcaagcacggtgccgacgtccatgaccagctcatccttgttcatcatgagctggcggaagcgttcgggcgaaatacgcgagttatccgttacaaatttgacgatgcgctcctgcatccggtcaaaataggagagcgtctgcggcacgccgagcacaagaccgttcatacgcactggatggacggtcatcgtggcggacggcacaataaagctgcgccgcgccgatacggcgagcggtacgccgatggaatggccgccgccgagcacaagcgaaacggtcggcttgcgcatcccggagagcagctccgcgattgcaagccccgcctccacatcgccgccgacagtgttgagaatgacgacaagcccttcaatttcagggtcctgctccaccgcgagaagctgcgggatcacatgctcatatttggtcgtcttgttctgtgcgggcaaaatatagtgcccctcgatctgcccgatgatcgtcagacaatggatcacatgcttgcccttgctggcggtgacgccgccgatctgaatgatttgatcggtctgctcaggcgagccggtttcaaactcgtcaggggcgtcctgaggcgtatccggctggttgttatcaagctttttcaaatcgtttcactccctatcgaactggtaacgattttagcattgacaaatcttcgcccgttatgccttgcacagaaagaagcggcccgctgacgaagcaggccgcccgcgccgcaatcctgtctgtatttataatagcgcagcggcaatgaacccgcataatctggttcaggctgtggcgcaatatgcacagtccgctggttttttagtttgcagccgcccggcggctgcaaacggctttgccgtttgcctgtgtatattatagcatctttgccttcggcggacaagggtcaatacgcaccgccggcggctgaaatcagaaccggcgccccggctttggcgacgtcagtgcgcctgcacggcgcgcgcaatggcggcaaactgctccatggagagctgttcggcacgcgcgccggacggcacgccggcgcgcgcgagcagcgcggacgtattgcctttggacaggccaaggccgcttgaaaggcagttgagcagcgttttgcggcgcatggaaaaggcagcgcgcaccactttgaaaaaaacggcgggttcgcccgcgtcgacagccggcgcgctgcggatatccaggcggatcacagcagaatcgacatccggagagggaagaaacgaaccgcgtgaaactgcaaaaagcatatgcggctcgctgaagtagcgcaccgctatggacacagcgcccacgccgcgcgtgccgggctgcgcgcaaaggcgctgcgcggcttctttttggaccataaccgtgaccgattggacgggaagacgctgttcaagcagcgccatgacgaccggcgatgtgatgtaatacggcaggttcgcgcagacgacgatatccagcccggcaaactgttcagcgatcaacgcatgcagatccacctgcaaaacgtcggcgttgataatctttatattgtcaaaaccggcgagcgtttccgcaaggaccgggagaaggcgcgcgtcaatttccacgcagacgacacggtcggcgcggcgcgcaagctcggcggtcagcacgccgacgcccgcgccgatctccagcacgccgacgcctggccgtgcgccgccttgctcggccatgcgcgggcagacggttggattgatcagaaaattttgcccaagagccttggaaaatgtaaatccatgccgcccgagcacatcgcggatcacgccgatattggtcaggttgtccatcgcgtcggtcccctttctacatgagacgccgtaaaaaacagttgcgccatacatgaaaacagcgtaaaataggaaaaacagtaaaagatcatttgtttattataaaggatgtggagaaagatgacaagacgggataaaatcaattattacctcgatattgctgaaaccgtcgcggagcgggggacctgcctgcgccgaaatttcggcgcgattattgtcaacaacgatcagattgtttcaaccggctacgtcggagcgccgcgcggccgcgagaattgctccgatctgggctattgcacgcgcgagcggctcaaggtcccgcgcggggagcggtatgagctgtgccgttccgtgcacgctgaaatgaacgcgatcatccatgccgcgcgcagcgagatgctcggcgcgaccctttatctcgttggacgcgaggtttcagacggaagctatgtgaaaaatgcctgcccctgctccatgtgcacacgcctgattatcaacgccggaatagcgacggtgattgtgcgcgacgacaaggatcattacagggtcctggatgtttcgtcggaatggattgagaacgacgaatcgctgcacggcatgtccaattattgagggacacgaatggaaaaaaaacagaaaacaccccggatcgctccaacggcgcatgtcgcgccgggcgcggtcgttttgggggatgtggcgcttggggaacaggcgtccgtttggtataatgccgttgaagccggcggccccgcacgcgcgccgctctcttgctcaggatgagattacagtcaaagcccgctgcgccgggcatgatactaggctttgcaaattggatttggataatttattgtatcatgaaaatctttccttaatataaaaccgaatatctgataaaaatatcagggtggtgttttattaatttttccggctgatttgtgatatggaattctggcaatagccataattcttgacttttccacatatataccatataatcgaattgttaaattagcaaaaaggggtacccctttttgctatcatctgcacatgcagatgatagcaaaaaggggtacccctttttgctatcatctgcacatgcagatgatagcaatctgtactgtcggacccccaaaggcgatttaatcaataaatccgaaatggaaacattttggtccgatggaggcccatgatcgccgaagggcatggccgccaccgggggtacggcaccgccctcgcgacttctcgcagaatgtgagatccatgaagtttatcgtattttgcaggaatcggaaaagtcatcaaaactgatgaatggtgtcgggagttatcacaattaattgggaggtttcaacggagtatggcagcttggtccacaaccacatattgtctcaagctccactgcaaacgccgggactggattttaaaaacgcaggcgctttataatgatgtgctttcgttttacagccggcttttgctcaacgacgtatcgctgctggagctggataatatgaagctgctgagaaagttggagcagatgacaattgccggacgggacaaaaagcagccggaagtcgaactgccgtttccaaaattaccgctgtatttccgccgtgctgcaatcaatgcggcaattggcatgattcgttcctataccggcaggctgcgcggatgggaaaaagcccgggaagatgcgcggaagaaaggccttatctggaacagaaaacctcccgccgccccatcgcatttccatgcatccacagttttatataaggggatgtataagcagtttggccaaggacgtatcctcataaagctttggaccggaggctcttggtcatgggttggacatgcctacagcggacgcagcatcccgccgaatgcgcgcacattgtcgccgtcaattgttgcgcgcggaaaactaatatttctgcatgtacccgtgtcctgccctgttgaggatatacgaagtgtgcgggaacggaatgcggctggcgagccgttctgcggcgtcagcttttcggcgtcggatgtgatggcggcatgtgtagtgttcagcggcgacggtcgtgcgaacgcctcgtattttgtgcggggaggcaaagcttttgcgcaccgtaggaagcgactgctgaacatggttaaaaaaagaagaggacaaaccggcggcaaattggttgccggagaaaacgcaagactctggagaaaataccgcaatctcagaatggcttatgcgcatttagtaagccgcaggatactggatttctgcataaggcataaagtaaagacgattgtcattgcccagtacagttatgatgagcaaaagaagcgatactatggccgcggcatagctgcgtttccgggaaaacaggtttcagcatatctcaaatataaagcgtggcgtgcggggattattgtgacctcagtcgcccctgagtttactgcgtcaaaatgcagcgcgtgcggcgcgccggtaaaacgctataacgagcatcatcaggcttcggcgaattattttggcggaagactttttatctgcccaaatggacacagaggaaatgcatcgtataacgctgctgtaaatatcgggaaagcattcattcgaaaattcacaaatatacaggaagaaaaagcaggttgattgcgtaatgaagtccaggaaaaacagggagcagtataaacgcgcgatcatattcctgatttcttttctgctgttggttgtgctggtagcgttgttcggacttatttggtatcggtcatatgctggtataatcatacagccgtttttcagaaaaggtaactggttggtcataggagtttatgctctgctgctttacatttttacaagattgtatggaggatatcgaattggttatttcaagcgggcggaagtaatttattccgctgtcctgtcgacgctgatggttaatacggttacgtatctgcaaatcagtctgatcggccggcgttttatggacctgcgccctctggcggcgatgtctgtatgtgatatgggtgtgattatcctgtgggcgctgacagcggacaaagcgtaccgaaaaattttcccgcctcacaaaatgctgctggtatacggcggccgttcggctgagaaattgattttaaaaatgaatactcgatttgataaatatgatatctgtcaggcgattcatatttcagagggattggaatatattttttcctgcattgatcgattcgaggcggttgtaatctgcgatgtgaaggcaaaaacacgcaactgtattttgaaatattgctatgcgcgttcgatacgtgcttatttgacaccaaaaatttccgatacaattattcgcggggcggatgtgatccacctttttgatactccgctgctgctgtgcagcgggcaggggcttacttttgaacaacggtttgcaaaacggttgctggatataacagcctcattgattgcccttgccttattgtggccgtttatgctgttgatcgctgctgcaatccggctttatgacggtggtccgattctttatagacagacacgcctgacgttggagggcaagtcttttcagctctacaaattccgtagcatgcgcgtcaatgcagagcaggaaagcggcccgcgcctggcgcagagaaacgacgatagaatcactcccgtgggtgttctgatccgccgtttcaggttggatgagcttccgcagatgttgaatattttaaagggcgacatgagcttggtgggaccgcgtccggaacgcccggaaattgcagaaatgctggagtccgttatgcctgaatttgctttcaggttaaaggtgaaagcaggcctgaccggttatgcacaggtgatgggcaaatacaatacggaagcctatgataaattgaaattggatctgatgtatattgaacaatactcgctgctgctggatttaagattgctgttgatgacgataaaaatcatatttttgcctggaagcacagaaggcgttgagaatgattgcctgtgtagttcgtcggaacgcagcagaaaatgatgtctgaaataggaggcgggcatatgcataggcctgaaaatcaacaatgcggagtcctgaaatatgcccgctatattttaaagaaatattgggaactggttatatacggcgtcgtaggcgtttgcacgactgttgtcaatgtcgttgtctttcagattttgtcggaaaatggtttggctctgttttggagcaatgctgcggcttttgtaatttctgtattgtttgcatatgttgccaattctctggccgtttttcatgcgccgctttctattcgttcctttctccagttctgggggatgcggattgtcagtcttgcaattgacatggggggactgtttgcgctgatcgcagcgggattggacaaactggccgccaaaattattgtcaatgtggctgtcattattgccaattacctgttcagtaaactggtgatttttaaaaaggacaagggacataaaaatggagattgaaaatagtcagtcaccaccgtattctgttttgatggcgacatattgcggagaaaaagccgcgtacctgcatagaagcattgaaagcattctgaatcaaacggtaccggctgacgattttgttttggtttgcgatggcccgttgacgccggaactggatgctgaattggaatactggcagaccaaaacggatattttgaatttgctgcggctgccgaaatctgagggacttggaaatgcattaaacaaagggcttgcgatgtgcaggaatgaattggtcgcacgtatggacagcgatgatatttcctgtccggaccgctgccaaaaacagctccatgcattttccgtgcacaatgtggaaattatcagtggcatcgttgaggagtttgaatccatgccgggtgattgtgcccggcggcgcttggttccggaacagcctgaagaaattatccgatatgcacggtcgcgcaatccgtttaaccatccctgtgtcatgttcaaaaaaagtgcggtggagtctgtgggaagctaccgcacatgtatgcaatatgaggattatgatttgtgggtgcggatgtttcaaagcgggatgcaaggctataacatccaaaatacgcttttgtggatgcgcgtagggaatggtttttacaggcggcggtccggctttgattattttaaaaaagggctttcttttcagcgccgccttttaaggacaggctttatcagtcgcggccgttttttatggaatgttatctgccgattcaccgttcaaagcttaccgctggatttgtgtgaacgcttctatcggcattttctcagaagcggcggtccatgcagataaaatcagttttgaggggatcagtagtcggcatgattaaaagtttaaaaagatacaggtttcttatctggcagcttgtagcacgcgatataaaggtaaaatatcgccgttcttttctcggagtggcatggagcgtgctaaatccgctgttgtctatggctgtaatcagcgttgtgttttcacagttttttcgctttgatctaccatattaccccatatatttgattacagggcagacgatcttcagctttttctctgaggccaccaatttggcaatgttctcaattcgtgaaaatgcggcgcttatcagaaaagtatcaatgccggtttatatctttccaatttcaagagtggtgtcgtctctggtaaatcttggattttcatttgtggcgattctgctggtagcgttgtttatgggtttttcgtttacgcctgcagttttgttcgcaccggtaacagctgcatatatgctcgtgtttgcgatgggaatcgggttgattctggcggcgctttcagtatatttccgggatattgtgcacctttatagcgtattgctgacgttgattatttatctcactccggttttttatccatattcgctgataccggaagaattccgttttttaatcaacgcaaacccgctgacttattttgttgccgcatttagaagctcattatacgacggcgtaattcctggcctgcagattaacttgttgtgcgttgcgttcagtctgtcaagtttgctggtgggactgctgttgttcggcaggttaagacgtaattttagtttgtatctatagtgagcggaggaagcaatgagtatagcgattcagtcggatcatttgtcagtccgatataatttatcggcgaatcgggcggacagtttgaaggaatatttgattcgtttggtgcgcggaaagctgttctatgaggaattctgggcattaaaggatataagcttttccttggaaaaaggccgggtgctcggagttatcggccataacggtgcgggcaaaagcacgcttttaaagacattggctggggtgctttttcccacaaagggcgcgatatgcatcgaagggacggtggctccgctgattgaacttggggcgggctttgatcctgatttaacgggccgcgaaaatgtctatttgaatggtgcgattctgggttatacaaaaaaattcctcgatagccgctacgatgaaatcgtcgccttttctgagcttggcgattttatggatgtgccggttaaaaattattcttccggcatgtatgcgcgcctgggtttttcaattgcaacgcttgtggaaccggatgtgctattagtcgatgagatactgtccgtcggagatctggattttcagcagaaatgcgcagggaaaatacaggcgcttttatcgcgcgggacaacaatcgtcatagtctctcattcgatcgaaacgatcaaagagctttgtacagatgtgctttggttagagcatgggataattaaacaatatggcggccctgccgaagtgtgcggtcgttatctggaggaggggacaggctcatgcggatagatttgcatcgctttgccgtgccggatacagaagtctgcacagcggaggatttgtattttcgcagagatgagcaaaaggttgattacgattttgagaatgaaaaatatgtgtttcaggagaaggggacgatagaaggaaacacatacttcaatgtgttctgcgcatccaaatgggcgcagtatacatcagttaccaaattaggagtatccatacagataaaaggatcatttgatatcgctttgatgcgaagcaccctgatcgatgggcagacgtcgcatacaactgtaatgcagcgccgatttgattccgacgagaaaatgttgtgtactttttcgtacaacttttcttatgatcagtttccctatttatattttgtccgtctgacagcgcgtgcggatgacagtgtcttttacggaggcggctatttcacagagacagaacaaccggatcctgtgagaatcggcattgtattttgtacatttaagagagagaaatatatttaccgtaacgcggccttatttgacaagtacttttttcaaaacgagtattctccctgtcaggaccaattgagggtcttttatgtagacaatgcagggacgctggatcccgtgaattttgatgggaaaaatcagacggtgctgaagaaccgcaatgttggcggcgcgggcggctttacacgcggcatgattgaagtaatgcgtcggcgcgacctgttcacacatgtactgctcatggatgatgatgcgcagattgacccgcattcgatagagcgcacctgcgcgtttttgtcgttattgcgccctgaacaccgcgatttatttatcggaggcgcaacgttgcgcctggacctgcagcatgttcagcttgaggccggcgctatttgggacaacaatgtgctgattaatttgaagtgcaattatgacctgtcagaagaactggacctgttaaaaaacaacattgatgaatcgcataattacaatgcatgggtttatttctgcattccattaatggccatatcggatcaaaaattaccgatgccgctgtttgtacgcggcgatgatatggagttcggcatccgcaacagccgtaaactgttggaaatgaatggcgtctgtgcctggcatgcgcctgtacacaaccgttattcattttttatgacatactatgttctgcgcaatcaattgattttaaatgccctgtatgaccgtaaattcaatgcacgcggagcggttggcgttatttttcacaatattgcacgtgaattgctttattatcgatacggcaatgttgaacttgtgtttttagcggcagagcattttttgcgtggcattccatttttacgtgatacggacgcgcagctattacacagcgaaattatgaaatacactcccaaaatgcttgatttcaaccagctttcacaaacagaatatccattttccattttgaaactacagttgacgcaggcccgcaaggacaggcggataaaaaagctgctgcggctaatcacctttaatggctacctgttgccgcgcattttcaacaggcgcggcgctttgaataattttgctgtagtagagctttataattgtcggcctattgaattttatcgaactaaatcggtgcttcaagttgatatgattaatgaaaagggtgtcattacacagcaagataaagcatgttttattaaaaccggttttcgttttctggggttggcgcttcgcatgttgtttggaggttatcgaaaagcgtgcagatcctttatagaggaacaggaaacggtaacaaatttatcattttgggaggattacttaaactgtaaggaggatcaaaaacatgaatgctgaatatatcattgtaggggccggcttatccggtatagtgcttgctgaaagactggcttcaatcgggaaagaggtgctgatgatcgagaaaaagccgcatatcggcggcacatgttacgattgctataaccatgaaggccttttgatccatcaatatggtccgcatatttttaatacggatagccgcgaggtttgggactatgtcaaccgtttttcaccattttttctgtatcatcatcgtgtagtcggcgtaatcgatggacagctcgtacccatcccgtttaatctgacctcgcttcatcagttgtttccgaaagcaatggcagcacgtctggaggaaaaattggtcggattgtatggttacaacgtcaaggtccccattatgaagctgcgcgaacagcaggatcaggaactgcagtttttggcggattatatttatgaaaaggtttttttacactatacgcttaagcaatgggggatgcgtcccgaggaggttggagacggagcgatgttccgcgtgccggtgcatatttcatgggatgaccgctattttcaaaatgcctaccagggaatcccgaaatacggctatacccggatgatggaacagatgctctcgtcagacaaaattcactgcctgaccaatacggattacagacgggtgctttctattgatgaggatggaaaaaccattcgatttctggggaatccgtttgagggtaaagttatttttaccgcgcgactcgatgaattatttcatcactgctatggcgcgctgccctacaggacacttgatttccgttttgagactttggacatgaaacaatatcaagcggtctgtacggtcaattatccaaatgactatgcgtttacacgtattacggaatttaagcatttaactaggcaggaacattcgaaaacaacaattgttaaggaatttccggcacaatatgatccttcacggccggagctggagccgtattatcccattcccatggaaaaaaaccagcttctttatcagcaataccgcaaacatgcagcggcctgtcccaaccttgttttgtccggccggctggcggattaccgttattataatatgtctgatacaatcaaaaacgcattgcgtgtttttgatgaacagttgagatagaaggcggaactgcgctgtggcaatggaagtaatttcagttattgtcccgatttataatgtaaaaaacgatctgcgcgcagcaatggaaagcctgcgtgcccagtcgttcggcgattttcgtgcttggctggtcgatgatggctcaacagatggctccggtgcggtctgtgacgaacttgcacgagaagacgcgcgcttctgcgtgctccgtcaaaaaaattccggtgcacatgcggcgcgcaacacggcattggcaaattgtcagggtgaatatgtctattttatggacgctgatgatcttattgaacgggaaaccttggaacggctgctgcaatgtgcccggcaaacagatgcagatattgcagtctgcggctatcagatagagtaccggcgtgccggacaccttgcagactgcaaatctgtccctggttttgacggtatcatggccattcctggagcactgccggatgggttgaccacggaattaatctttccgccgtggaacaagctttacagacggtcatttctcatgcggtacaacctgcattttccagcgacttattgggacgatacgatctttaatacagaggcgtttggctatgcccgcagactgggttttattcgttacagcggctatcgttatatcaagggacgcgccggtgcagaaacagcgaaattccgtccggatttgcttgaaaagcgcagggctgaattaacggcgctggaacggctcgtttatgaaaaatgggaaattcctactttggatggaacgcggatgatagcagattgctatgtacgcaatctttggggctgcttgaccgcgagctttatgccgcaggtcagccgtcaaaaacggcgccaaatattcagtgaagttgcccatgattctgctgcaagacattatgcggcttttataaccaagcaggcgcatcttgcgccgggaatggggatgctgcttcgttgcccctttataacgcctgtatatcttgtttcatggctgcttgcgcatattcgtatgattgcgccgcatggctttgatcggttgaaacgataattgactgaactgaaaggaaaaggatatatggatttaatgagagccgttaaattgattgcgctgtatatgtgcctaggctttttgctgttggcatgcggttgtatggatttatcaaatgaatccggtcttggaaatcctccacccacagatgcaacggcttcaaatcctgagactacgccatccgcggagattgatccagccgctgcgattgaacaggaattggcgctgcgcagaaacgaggccgagtctatcttgttttcacaaaaagcggttgacgctcaactgttgtcagaactggagaaccctgcgcatacattgaaaaatccatatatctgcgtcgatccctacgggctgtccccattgagcgcaatgctgcttttccagacggaggagccggtcgcgatttccatacgcgttccggggaaaaccgcacaggccgatgttacttttgcttttgacagtttggagacaaaacactgtatacctgtttatggtctgtatgccggacaggtcaatcaagtggaaattacggcgacatcagccaagggcgagagtgaagcggcagtgattccaattgaaacacagccgcttcccaaagcgttggcagacaatattttgatgacggaaatggtgcagccggaaaagtaccaggcaggtatgaactttacaaatccgaccggaccaggattaaaaacaacggcatttgattgtaatggggattacaggtggtatttgtcggatgagtctctgatttattgtcggtttgcatttgatgatggacgccttatggtagcaaaaggggcgcaggaacaaggtgtgacaatcttttatgagatgaattatgcagggaaaatattcaatctttatgccggattgtatggctgccatcatgatattgagccgacggatcacaatacatttctggtaacaggtacggaaggtgaaactgttgaagatatgatctatgaaatcgaccgtatcacaggtgaaacggttagcaagctggatatgaaggaagttttccagcgcacgcgttttttaaacgacacgatcggttatggatcccgcgactggctgcacaacaatgccgtcacatggctggatggagaagataagatcatgatttcggcccgtcatcagtctttggtagctcagatttcatggccggaggggaccatcgactggattttggcggagccgcgcggctggctcccgatgttcgaaccatttcttttgacgcctgtcggcgacacgtttgaatggcccagtcatcagcatgcaccaaaatatttgccggatcaggacggagatccggatacggtggacatcctcctgtttgataatggcaacgagcgtccggagctttattcacgcatggtccaatatcggattcataccagagaaagaacagtggaacaaatctggcaatatggaaaagaacgaggcgaggaactgttctcacaatttacgggcagcgcaaatttaatggagaatgggaaccggctgggcaacttcagccgatatcagcaaataaacgcacagagcagctttaatgccttgcctgaaggcagttccgcgttgtcaatgagcaatatattttgtgaagttactgagagcggcgaacgcgtttgggaggtacaggctatcgacagaagttcattcagtgcctatacaagctatcgtctggagcggcttccgttttataatgacagcgatctaaagttgtggctgggcgtcgacggcgcatatcatttttaacgatttattgatcgttgggagaggaaagagagattatggattgggtccactttcgtattggggtaacaaaagttcccgtaaaggataatttaaaatttgcatttgcatcgtcatttgtgatagggatacttgtgcacttcagcgtgctgtccaataatcttttaaaccatgacggtgcaggagcattttactggccacatagttttgtagatcacggacgatggctgttgaaatcggtttgctcaatcagcacatactttacgattccctgggttacgggtattctgtccattttatatctttccattgcaataacaattatagtggaaatattttcaattcagcaaaaggtcagtattctgataacagccagttttttgatgacctttcctgcattgtcttccaccttttcctatctatatgtcgctgacggttatatgctgggagtggcctgcgcctgtttgtccgttttatttgtacaaaaactgaaacatggatatctttggggtgcaattccgctggcgtgcagtctgggaatttaccaggcgtatttatcaatatcgattcttttaatcctgcttttattgatcattcaaatcctggattcaaagagcactgttcaacagatatttttaaagataaaagactatttgttattgggcttgtttggtgcggttattgatttcatatgtatgaaagccgcacttttaatcaccaatatgaatttgacagattaccagggagctagttcgattaatcaatattcactgtcaattgataatatactgaaaagtatcgaaatttccattcaggaatttttctcatttccccagcagtcttcgattagcggatatgggtttattaaatatatattgatagcatatgcagttatttttattttgacagtagtgctgattatcaggaaaaataaaatttacaataatccaataaaaataattttattgcttttgatctttgcattccttccgtttgctttggaaattatccgatttgttattccggacgtatggtatcatatgctgatgaattatccatggtgcatactgtttatcagcgttcctttgcttcacgagctatatataaacaatgtgaaagaaatatacattggcaaaggatattgtttactaacgaattttgctgttatttgtgctatcattattattttcgtttattttttaatttccaacttggcatatttcaatatggaaaatcgagttaataaagtttatgggatgacggttcgcatggtggatcgtatcgagcaggtagatggctttacgtttgaaacgccggtacttttttggggggatacccggtattcaaccgaaagtcaagcggatgagtatttggaaggactgattggtacaacaaataatgattttatcatttccgatatatattataaagtctacatcgataataccttaaacctgaaattcccaactcctgaccaacagacaattgagaaaatcagaaataatgagcaattcaggtcgatgcctctttggcctgcaagggattctgtacaaatgattgaaggagttattgttataaaggttaatagtaatggggatcgatgggatcatttatcgtaaaaggatgtttatatgaaaataacagatttacgcattgtgaacacaattataccatttaaagataagtggaaatttgcctttactgcatcgtttataatggggatgcttgtacacttttacatgttcacacataatttgttgagtcatgatgcagcgggaacgttttattattctgctgattatgtagatcacggacggtggtttttaaaatcaatctgttctttgagctcctattttcaactgccatgggtgacgggattactttctgttttctatttatctatttcaattgttattcttgtagaaatttttgatattgagaacaaaattagtattgttgtaatagctggttttctaattacgttcccttctttggccgcgacattttcatatgtatttgtagcggatggctatatgtttggcgtgctttgcgcctgtctgtccgtcctgatggtccaaaaaataaagtttggatatatttggggggcgatcccactcgctttcagcctgggcgtctatcaggcgtatctgtcaatagcaatattgcttattatgctgttattaattgttcaaatcctggactcagaaagttcggttcgatcaattcgaataaagatcagagaatacctgttatttggcatattgggtgtagtaatcgattttatttgtataaaggcggcgctgttcattacgaattcaacgctgattgattatcagggagccagttcgattaattccttttcactatcaattgacaatattatgaaaagcgccacaatgtctgttcagggttttgcagcatttctaaaatggccgtcaatcagcgggtatgggattatcaaatatgtattgatggtttatgcggttatttttattttgaccgttttattggttgtcagaaaaaataaaatttacaacagtccaataaaaatagttttactacttttgatcttagcgtttaccccttttgctttggaaattatccgatttgtcatcccggatgtatggtaccatatgctgatgtattatccttggtgcatactgtttatcagcgttcccgtgctgcatgaacgatatataaatatggaaaaaatttacacgggggggtactgtttactatccaaccttgccgttatttgtgcatccatcattatattcgtttattttttaatttccaatattgcgtattttaacatggacgcacgcatgaataaaacatatggaatgacgctgcggatggtagatcgtattgaacagacggatgattttacatttgaaacgccggttgtgtttataggatcacttcgctattccgctcaaaataaggcgatggattatataacgggtatgattggcactgaggcaaatgatattctagggaatgattggcattataagttgtttattgaccactatctgaatctcaaatttcctacacccgacccgcaggtaattgaatccatcaaaaacagtgaacagttccaggatatgcctctctggcccgcgaaagattcggtacagatgattgatgggacaattgttgtaaaagtgaatgataactggtaacagagaaaggaggcgcctgatgcgttacgataaaattataattggtgcggggctgtatggcttgttcgcggcggaacgatgcggacggcggggcgaaaaggtcttggttttggagtgtgatgcgggaccgtttatgcgtgccacctatattaaccaggcccgtgtccacatgggataccattatccgcgttcattgtcaaccgctatcaaatccgcaggatatttcgagcgttttatgcaggattactcattttgtgttaaacaggattttgaccagatatatgcgatatccagagacttttcatggacaaatgcggaacagtttaagcggttttgttctgcggccaacattcgatgtgattggcttgatccggacgtatacttcaacgccgggttgtgcgaggccgcatttatgaccacggaatatacttatgatgcgcagattcttaagaaacactttctggaaaagctgggcaatatgccaaatgttgaaatccgctatcgaacaatgattgagcggatagaacaaaaaaatgatgtgtatgtgattgcggcacaagatcaagagacatcggaaagcgagttcattctgaacgcgacttacgcatctacaaatcagatcacatccatgcttggatttgaaccgtttcggatcaaatatgagctttgtgaaattattctctgccatgtggaggaccgatttaaaaatataggaattactgtaatggatggcccattcttttccattatgccattcggatgcactggattgcattctctgacatcagtgacatttacgccgcatataagttcatttaacactttaccgcaatttaattgccaggaaaagagcaaggggtactgcacaccgcagcatttgggaaactgtgacgaatgccggtttaaaccggcatcaagctggacatatatgtccagcttggctaagaaataccttcgtaaggaatatggatttacttattataaatccctgttttccatgaaaccaattctgaaagcatcggaggtcgatgattccagaccgactgtggttagaatattttccagaaaaccaacatttgtaagtgtgttatctggaaaaatcaatacagtttatgatttggagggtattttagatggagaggaataaggaaaaaaattttatatctgttgttttatatttatataataaggagcaggaaatatcagtctttctgccaaagctgtacgcgatgctggaggataactttctgaatttcgaaatcatttgcgtcaatgatgattccaaggatcagagccgggaagcggtaaaaaaatttgcaggacaagttcgtggaaaagcagtgatcagtctgattgatatgagtgtttatcaggggcgggaagccgcgatgaacgccggtgttgaacttgcaatcggagactatgtgtttgaagtggactattttgaaaagcttgacggacttttggagcaatttatggccgtttacaataaggccatggaaggatatgatattgtttcgttagtacctgaaaatcaacgttggtcgcgtcgttcatcccttttctatatgctgtataatcgattttcgaagggagcgcagaagttgtatccggagttattccggctcgcctccagacgggcgatcaatcggatgcatgcgctggggaaatccattccataccgtaaggctctttatgcaaactgcggattgctgcagacaaaaatcgaatgttctttgccgttgtctaatcgtctcagctttgagaagtatgagcacagaaaccgtgcggatacggccgtcgacgctctgatactctttacagatgcggtcacaaaactggctctttttatcagtatatgctttttggccgtatcgcttttgatcggtgcgtatgtattttatgtgtactttttcggtaggcgtccggtggaaggttggactccgattatgctgtttctctccctgagctttttaggcctcttttttgttctggcaatcgtattaaaatatctttcgcttctgattaatttagtgtttaagcggcgccagtaccttatcaaagggatcgagaaactgagttgaggaggaaaatgatatgacactgcatattgttattccagtattgaatgaacaggatcgtctggagagcgggattacagagctgcttaaatatctgaaaacctccgctcttaaggataagacttatattacgattgcagataacggttcaacagataaaacagaggagattgccaagcgactttgtgagcggtatacgcagttacgttataagaagcttgaccaacgcggcgtcgggcttgcttttcgtacttgtatacaggaaaatacagacgatatcattggatatatggatgtggaccttgcaacagatttgaaacatttggatcaagtctgtgaggaatttgaatcaggagcccaaattgttgtcggatctcgccttttaaaaaattcaaatgtcgtagggagaacgctgaaacgtgagatcacctcacgagggttgaactttcttctaaaggttttgctgcatgttaaattttcggatgcaatgtgtggctttaaattctatcaacatgatgtggcattggaattgacccggttatgtagtgaaaacaagggatggttttattgcgctgagatgatgattagggcagaatggctagggtatcatattacagaaataccggtcacctggagagatgatcctgagggcacaaaggtgaaaatcggtaaattgagtatgtcgtatctttctgaaattaaaaaattgcggagggaaaggaatcaactaaaaaaatgaaagcggcgttgataggatacggttattggggcaaaatcattgaaaaatatatttgtgacagcacatacttcgaccttgctgcggtttgtagcccagagctggataataacggaatttatacgaaagaccttgaaaaactgatgtatgatccacaattggaggctgtatttatttgtacgcctgtttccactcattttgatatttgcaagaaatttttggaatctggaaaacacattttctgtgaaaaacctacagtaaaaacattagaacaatttcaaatattaaagaatttggcagtgaaaacgcatagaatactatataccgattatatttatacagtatccccttccattcaaaaaatgaagagcctccttaaaaaaattggtaatattcaggttattagcggcgaaatccgccaattcggccgtttttatgaggaagacgatgtatttgaagtacttggaatccatttattgtcagttgcggctttttttttgaattcaatttctgttcatacgattcaatacgatccatgggataaagcaagcccctgcttatccggcagaattgagataagatttgataatggaacaatagctgatcttgcatgcagttctatttatcccgataaaatcaggcgaattgtagtgcaggggacaaaaggaattttgatttttgacatgtatggaaagcagacccttcgttactttccatacagcaggcaggcgcatctctgtgtgccagagcaagaggaatcatggcagttcgatgagggaaataatttacaacgggcgattaaacaatttggcgctctttgtgatggcgagatagaccctaccaatctagttctatcagaatgtgtgattaaattgttggacaggagaaaggaatttgtcatatagatgaaagcagcgggaccggaatcatatccggtcccgctgctttcatattatttttgattttctgtcttaggatacgcttcattaatctggtaggacaatgtcatgaggctgtcgcccagatgaacgttttcaacgatcacgccttcgaaatcaagcgacagatcgtagtgggaaaagttccagaagcaattgacgccaagctccatcaagcgctgtgtcgtctcaaaggcaacctccttgggtatgcacagaacagcggcgcgcggcgtgtgcgcacggcagaaatcttcaagctccgccgcgtcgcggacgacaagatcgcggatcgtctggccgacaatatgcacactgttgtcaaaaattccgatcagccgaaagccgctgctgtcaaaatccatatggcgcgcaatggtgcgtccaaggttgcccgcgccgatcaaaaccatcggcatgtggcggtcaagccccataatgttgccgatctccttatgcagcgcagccacgttatagccgtaaccctgctgtccaaacccgccgaaacagtttaaatcctggcgaatctgggacgcggtgagctgcatcatctgggcaagctcccgagaggaaatacgggtaacgccgcggtttaacagctctccaagaaagcggtaatatcgcggcagccgcttgataacagacaatgaaacgccttcacgcttaggcaatcagaaccaccttcctttcgcgtcctggcggtatatttcaagacccgcccgcatcggaccacgcaaaaaacgcagccgcttcttacagacgcgcgaccgtgtccataacataattaccaaattcctcacaggtgcagccggtatcgcggcctgtgacagtcagcttcttttcctcatacatacagatatcgagcgcccgctcgagcttatcggcctgttcctgatacccgatatggctgagtagcagcacggaagcgcgcagcatggaacagggatcggcatatttgccgcgcccctctgaaatcatccggggcgccgaaccgtgaatcgcctcaaacatcgcgtagcgtttgccgatgttggcgctgccggccgtgccgacgccgccctggaattctgccgcttcgtctgtaataatatcgccgtacagattcggaagcacaaacacctggaaatcacggcggcgcttttggtcgatcagcttggccgtcgtaatatcaatgtaccagtcgtctgtcgtgatctcgggatattccttgccgatctgttgacagagcttaagaaatttgccgtcggttgtcttaatgatgttggcctttgtgatgatcgaaacgcggtttttatggtttttgcgtgcataatcatatgccaggcgtgcgattcgctcagtgccttcggtcgtggtgacgacaaaatcgaacgccagctcgtcgtcgatattgattccgcgcgaaccgaccgcatagccgccttcggtgttttcacggaagaaagtccagtcgatgccttcgcccggcaccttgacaggacgcacgtttgcaaacaggtcaagctccttgcgcatggccacattggctgattcgacattcggccagggatcgccggcgcgcggcgttgtggtgggaccctttaaaattacatggcactttttcagctcggcgagcacgtcgtcaggaatagccttgtgttgggccgcgcggttttcgatcgtcagaccgtcaatcgtgcaaaattcgatcctgccgctttttacgtcgtcggcaagcagatgctgcagcacgcgcgccgcttcatttgtgatgatgggaccgatgccgtcgccgccgcagacgccaacgatgatcttgtcaagacttttgtaatctgtaaattccttttcggctttaatccgttcgttgcgctcgagctgcatctgcacaagcgctgcgaatttttcagcggcttctttgattttctgttccaattgcatttccccctgtcggtttattgaacgaacagcttattatgataattttataacaggcagtatcaattgtcaatcaacaggagaaatttgtccgcccgcatcaggcaaggaacaaaccggcgtccatacagaccgccgccatgtcctgcattgtgcgccgcgcggcagccagccggcggctgacggtcgatggatggatgccaagctgccgcgcgatggcactgcggcttttccccttaaaaaaataaagctcaacaacagaccgctgccgctttggaaggcagcgtaccgcgctgcgcgcaaagcgcgcgtaccgcgcgcgcacggctgagttgtcgccgcctgagccgcaccacagcgaacctgcgaagtccgcataaaaaaagccttccatggaccgttcagacatggcggcttcccctttcatccggctcataataatgaagcagataagcgcgtacagcgcgcagctcggtcagctcggcgcgcatcgtttcaatacgccgctgaagcgaaaacgcttcctctccacgcgccgttttaagaagcgcgcgcagctctgcgagacgcctggaaagggcgtcggctgctgtgcggtattcctcggaccactcggtaaaatacataaaatccccctttgcatgcttggacagcttttacttttttgggcaaagcccctcttatctccaaagtagcatgcaaaaaggcgcacagcaacgaaagcggcccacgatactgaaagtggaatgatgcgcgcaaccaactggtcattaaatgggactatatgcggcggatgggcagaccgtggacggcggcgcggcctgtaaaagcgaatcggccatcccactgttcgcggcgcagccgaccaaagttttttgccggggttttttaaaaaagcgggaagcaggagcctgcaaaatccgcgtccggccgcatggcgtttgtcatggattttgcttggggcaggcggagcgccccagcaggattcttgcggcctgcgggccgcgtttttatgaaggctgcggcccggggtaagggcgctgccctcgaagaaaggcaagacccacaaggggccttgccttttttttcgcccgccttttttaaaaggcgggcgaaaacttttgaccgacgcggcgtaaaaccagattacgcagcgcccgccccgctgttcgcggcgcagccgattaaagttttttggcttaccttttttcaaaaaaggtaagtttcaaaatagcgggaaaagttcaaaggaggcttcgatgccggtgcaggcgagcgcctggccgtttgtatctgtaaagcaggcaagctgtgcagccatgtatgtcccggctgggagcgactcctcatagatgtcgagcgggacctgaattgtgaccgtttcaccggcgggcaggatcagcgattcatccggctgtaaaacggttgtgcgcggcgtcagtgggatgacctgcccgtcttccaggcggcggatgtcaaacacatgggtgtaaagcaaatcgcttttcgaattgtttgtaacgatcagctcaatctgcgccgtaccgaccggatagcgatcggccgcgcgcgcatcgacgctgccctgcgcgccggcgctttccggaaggggcagcccgtttttcggcggtggtacttccgcgctgccgtcattcgtaccgggcaggccgatgaccgtcgtgaaccggtcgtttgtcgcttcgggcaaaaataaatccttttctccggcggaagcggtcccggaagatgtggggagggaactggccgcgctcgatgccggcggctcgcttgatccggacggcgcggacgaaaccgcagccgcaccgccatcctgtgccgtgcagcctgtcaaaagggctatacagagcagcagcgcgccaaaggcgcgcggcatactaaacattaaaccggaacaggacgacgtcgccgtcctgcatgacatagtccttgccctccgaacggacaagccccttttccttggcggcggccatcgaaccgcacgccatcagctcgtcaaatgagacgatttcagcgcggataaagcctttttcgaagtcggaatgaatcttgcccgcggcctgcggcgctttggtcccctttgtgatggtccaggcgcgtacctcctgcttgccggcggtcagataggagatcagcccgagcagatcatagctctttttgatcagacggtcgagccccgattcatgcagccccatttcttcaaggaacaaaagcttgtcctcgggcggcatatcggtgatctcctcctcgatctttgcgcagatcggcagcacctcggcgtgctcagacgcagcgatttcttcgacttcgttgtagaatttgttcgattttataccagatgtaaaatcaaattcactcatatttgcggcatagatgaccggtttggccgaaagaaggggcatatcgtcgagcgcggcgcgctcctccccgtcgcaatcaaagctgcgcgccggctttccctcctccagatgcgccttaaggcggcgcagcgtatccgcctgcgcggcaagcgccttatccccgcccttggcggccttgagcgaacggtcgatcttgcggtcgacaatatcgatatcggagaaaataagttcaagcccgatcgtttcgatatcgcggcgcgggccgatctctccgtcgacatggacgatttcgccgtcctcaaagcagcgcacgacgtggacgaccgcatcgacctcgcggatgtgtgaaaggaacttgttgcccaacccctcgcccttggacgcgccgcgcacaagccccgcgatatcgacaaactcgataacagcgggcgtgaatttatctggatcgtacagtttggcgagcgcgtcaaggcggctgtccgggacagcgaccatgccgacattcggctcgatggtgcagaacggatagttcgcggactgcgcgcccgcgttggtaatggcgttgaatagggtggacttgccgacgttgggcagcccgacgatgccaagcttcatggattttgaccctccaaaacgccggatggcgtatattgatggcacactgcggctgaaaataacaggacgctatggttccctcgccggggaacaagccgaaaacggtgattgacggccgcacgaccggtcccattatacaccaaaatctctcaagcggcaagcgcgcgcaattaacggcgcgtgcatgtcccgttcaaaaaatattcaccaaaagaggtgattttattgtataatcgtggtaggatataaaaaggagctttggacagccgtgctgtaaggcgggctgccggtaaaatcaggaaggggcgccgctttttggcgcgcggcccggcaacaacgagggggaagcgccgtgtcaatcggaaaaatcctggtctgtgacgatgaccgcaatatttgcgagctgctgcgtctttatcttgaaaaggatggctatacggtttcaattgcaaatgacggcgaggaggcgctcgccaaatttaccgctgaagcgccggatctgattttgctcgacatcatgatgcccaagcttgacggatggcaggtctgccgtgaaatccgcaagaaatcggactgcccgatcattatgattacggcaaagggcgaaacgttcgacaaggtgctcggcctggagcttggctccgatgattatgttgtaaagcccttcgaccccaaggagattgtcgcgcgcgtcaaggcgatcatgcgccgcgcgagcaagtcttcggcggaaaacgatgtcaaggaggtcgcctatgacaagctcgttgtcaatatgacaaagtatgagctgaaggtcgacggccgcgtcgtagacacgccgcccaaggagcttgagctgctttatcatctggccagcaatccaaaccgcgtctacacgcgcgaccagcttcttgacgaggtgtgggggttcgagtactacggcgacagccgtaccgtcgatgtacacatcaaacgccttcgtgaaaaactcgagggcgtgtccgatcagtggacgctcaaaacggtctggggcgtcggatataaatttgaagtgaaggaatagggcttgcctgaaagactgttcagacagctcaaaatcaggacggcggcccgataacgaacccggttcgttatcgggcgctttccgaaaaggcggttgaccgccggccgtccggagaggaagcgttccatgcagaaaaccttatttagtaaacattttatcacagtggcggcgattatcctgctcagcatcacaattctcggcgcggtgctgcttgcatttgcgacgcagtattttaagcaggaccgtttccgcctgctggagcacaacgcgcagcaggcggcggagctgacctattccgattttcgcgagaaccggtatcagggcgtcacagtggccaaggtgctgccgcgataccggatcgtggccgatgcgatcgaggcggacgtttatcttgtggggatcgacggctcgatcaagctgctgaccagcgggacggacggcggctataacgatatcgccatccccagaaagatcattgaagcggctgtttccaagggggagtatcaggagcttggaaggatgggcggtctgtacaacgaaaagcattacaccgtggggattcccgtttcaacggaggagggcgtcccggcggccgtcattttcgcgtctgctcccgccgacacgctgatggtgtttttgtcggaaattctcaagatgtttgtcgtaagctccctggctgttctgattcttgcgtttgcggccgtttattttatcacagccgatctggtgcggcccctgcgcaaaatggtcgcggccacgcaggcgttttcaaagggtgatttcaccgtgcgcgttcctgtggagagctacgatgagattgggaagctggcgatttcgtttaacaatatggcgacctccctggcgaccaccgaggtgacgcgccggtcatttacggccaatgtctcacatgagctgcgcacgccgatgaccacgatcgccggctttatcgacggcattctcgacggaaccataccgcccgaaaagcgcgacgattacctgcgcatcgtttccgacgaggtcaagcgcctttcgcggctggtgcgctcgatgctcaatatcgcgcgcatcgaagcgggcgagctacagatcaagcccgacctgttcgatgtcaatgaaacggtcatccgcacggtgtttacctttgaaaagccgcttgaggaaaagggtatcgaggtgcgtggccttgataacggcaaggtcatggtcgaggccgatccggacctcatccaccaggtggtctataacctgatcgaaaacgccgtcaagttctgcaacgaacacggctatatcgaggtcagctaccgagccgacgacgcatatacctatgtgggcattaaaaacagtggcgatgggatcgccaaggatgagatcccgcacattttcgaccgcttttataaaacggataaatcgcgcagccgtgaaaagggcggcgcgggacttgggcttcatatcgtgcgctccattgtcaacctgcacggcggagacatcgttgtgcgttcggtcgaaggggaatactgtgaatttgttttctcgattccaaagccgcagaagggaaagaaggcgcagcaggcgattgccgccagcagtggaaaaatgtaaaagcttattcacaatcgcttcaacggttttcagtaatcttttcaaaccgcgtctattttatcttaacatttttccggtatactaacgtcagaaaacaaaaagatgcatcaaaaacaatccggaaaggtctgacgatctatgaatgataattataatccgaatcaaaacgcgccggacgagcaaaaccggcaggacaatggcgcgcacgacgccaatgcagggccaggcggacatgtctggaatgtgccgccgcaggaaggaactggcgattaccgtccgccttattattccgaagcgggcggccagtctccgcggacatcccagccgccgcagcagtattcggccagcgacggttggcagagccgcgacggacgtgacgtgcacggaaagacgccgtatcagtggaatttttcagaatatgaacaagcggcgggcgctgccaagccgaagcgccgccgcggcctgatggtgtttggcatcatcctgggttccgtgctggtcgtttcgcttgtttcctttgcggggatcggtatttacagcaccctgagccgggtgcccgcgccgtccgctccggcggcggatgagccgacgctccaggttccggcggacaacctgcccggcatcacaattcagaataagcccgagacggccgaggaaatactgcccgacggcaagctgacaagcgagcagatcattgaaaaggtttcgccctccgttgtggcgattaccacatatgtcaactatcagaattaccaggccgagggtatgggcagcggcatcattatccgcgaggatggatacattgtgacaaacgcccatgtaattgaaggcgccaagggcatcaccgttcagctcagcgatggaacgtcgtatgagggccgtgttgtcggcagcgatacgcagacagacctggccgtcattaaaatcgacgcggccggcctgaccgccgcggtgttcggcaattccgatcaggtgaagatgggtgaaaaggtccttgcgatcggcaatccgcagtcgatggcatttgtcggcagcgcgacgcaggggattgtttcaggcctcaaccgcgaggtgactgccggcggtcagaacggtacggctgtcacgcactataccaatttgattcagacggacgcggcgatcaatcccggtaactccggcggcgcgctcgtcaacgagtatggacaggtcatcggcatcaattccgccaaggtcgccgcgaccggcgcggagggcatgggctttgcgattccgtccaaccaggccaaggagatcgttgacgatctgattgcttatggccgtgtaaccggccgtgtgcggcttggcatctatgcgatcgaggttgacgaggttcttgcgcgtctcaaccacgtgcccacagggctgctggtccagtcgactgaggaaggttccgacatctccagcaagggcgtcgtgcccggcgatatcatcaccaaggtggacggcacagaaattgccggcaccagtgatttgtcagaggtgatcgagggtaaaaaaccgggcgatacagttgaactggaggtttaccgtccaagccagcgtccaaatggcgaaggccgcttcttcaatatcacagtcgcgctgatggaagatatgggcgataccactgcgcagcagccgcagactcagcaggttccgcagcaggaacaacagccgtctgaggatcaatattataacgatatggaggactttttcaaccgctttttcggctgatatcctctccctgcataggaccggtcccagcgccgtgtgcggcgctgggaccggtctttatgaatttgccggcgaacgccttttaaaatctgaaaaaacagccgagaaatcataatttgtttacaattttggtgtatactgtatctatggaaatggccgcggccgcacgccgcaaaaattgcaacgctttaaaggagaccgctatgaaacagcagcagccgtccatttatcatacgcttgtcctcgtaaccgatcagttcgcgtgtgaacgcatcattaaggccgcgcgcgtgatcgccgatttgtcaaaaacaaaccttcttgtgctcagcgtaatgcgggatggcgtctgtacaaaccctgctgcgttggagcatctgttcggcgtcgccaaggagtatggagcgcagatgacggttgaattttccgataatccgcagagcgcaatcacacattttatccgcaataacagggtgatcaacgcgattactggcatgccgaacgatgaaaattcgattcttgtccggatgtggaaaacgctgcgcaacgtgacattttttactgttacggaaaaaggcgagctgcatgaggttgtcgaccgggaataccacaaggatattgtgaatacgatcgtatgaaccttcaaaagatcggaggatgcatatgaatattacggttaaacagattgaatataaaagctccgcaacgggcaatacgattttcggctggatttatattccggcggagccggcttgcgccgcggtccaaattgttcatggtatgtcggaacatatggagcgttatcatgagctgatgcgttttctcgcgcagaacggctatgtggcatgtggaatcgatcagctcggtcatggacgctcggcgcctgacgaggagcatttgggcttcttcgctgaacaggacggctggaaacgcctgatcgacgatcagcacaaatttgcgcggattgtccatgcagaggcgcccggtctgcgcacggtgctgcttgggcacagtatgggttcgtttgtttcacgtatctatgcctccaaatattcgcagcagctcgaggggcttgtgctctgcggtacagggcgcggcgatccgcgtcttggatttgcgctggcggcggcgcgccgctcaatccgcaaaaacggtccgctttaccgcgaccgcagtctgcataagctggtgttcggccattataacgaccggtttcagccggtgcgcacaggcggggagtggctttcgcgcgatgaagcctccgtcatgcggtattccgatgacgcccgctgcggctttacatttacggccgccggttttcacgacctgtttatgctggtgcgcgaaagcaattcggccgcttgctttgaaagcgtgcgtaaggatctgccggttttgatcctgtccggcgctatggatccggtcggcgagtttggaaaagggccgcagacagtctgccgcaggtaccgcaaagcggggcttgagaatgtgcagatcaagctgtatgagggagcgcgccacgaaatcctcggggaactcaaccgcggccaggtctggagcgaccttctcacctggctccggcctttttgaaaaaaggcctcggcgaaaaactttagccggctgcgccgcgaacagtggggaaggccccagtttttttacaggctgcgccgcgaacagtggggaaggccccagtttttttacaggctgcgccgcgaacagcggggcaggccccggttttttgcaggctgcgccgcgaacagcggcgcaggcgcttcataatcggtttttacgccgcggcgatcaaaagttttcgcccgccttttgaaaaaggcggcgggtgagaaaaaaggcaaggccccttgtgggtcttgccttttttcgagggcagcgccctggtccttgggccgcagccctcataaaagcgcggcccgcagtccgcaggagcttgttcaggagcagggcttctcgccagcaaaatctgtgacagacgctgtgcggctggcacggatttttgccttgcgagccaaaaaaccatccgtcaatccagacgcgttgagatgttgtacaggctcttagagcggcggcgcttcttttttggagagctgttcgatcagctcggcaaaaaacaggaacaggaaacacacggcggccatcatgatcagcggaagggcgatgccgacgagcgaatagaacaaagatacttccagagaagcggagctttggaactgctggccggcttcaagcagcatctgcatctgctgtttctggttgaaatagctttggaaggtcaaaagcacctgacagagcaggtagaggaatgtgagcacaagtcctgcgatatgaacgcgataaagtgcgcgcgcggtgcggttttcaaaacgggcgcggcgcggcggcaggtccagctcgtccgagggaaccgcctttgcaagcaagccgccgccctgctcctgtggagtttgatccgtttctgtgggcgcggcggcctgcgcgtccgcggcagtctcctggatcgtgtctttttcaagctctggcatcatgcctcatcctcctttgtttgataaagtccggttgaaagatagcgttcgccgccgtccgggcagagcgcgacgatcagcttcccggcattttcaggccgctgcgccaatcgccgtgcggcggcgatagccgcgcccgagctgacgccgacaagcaggccgctgtccctggcggcgcggcggctggcttcaatggcgtcctgtgtcgcaacggtgacgatctcgtcgatcacggaacggtcgaggttttccggcacaaaattggctccaattccctggatgccgtgcttgcctgcgcgtccctcggtgacaagcggcgattcggccggctcgacaccgatgacacggatggccggattggccgccttgagcgcgcgcccaacaccggagacggtgccgccggtgccgaaggacgcgacaaaaagatcgacgcggccgtccgtatcgcgcaggatttcgcgggcggtcgtcgcctcgtggatggccggattggccgggttctcaaattggcgcggcataaacgcgccggggtgcgcggcggcgatctccccggcttttttgacagcgccggccatcccctcggcgccgcttgtcaaaacaagctcggcgccgagcgcggcgagcagcatcctgcgttcggcgctcatggtttcaggcatggtcagcacaagccggtatccgcgcgcagcgcagacaaacgccagcccaataccggtattgccggaggtcggctcgacaacaagcgcgccgggtgaaagcgcgccgcgcttttcagcgtcggcaatcattgcaaaagcggcgcggtccttgaccgagccaagggggttgaagtattccagcttgacggcgacacgcgcgttttgtacattgcttaagtacatcagcggcgtatcgccgataagctgtgtcagattgtccttgatattcatcgggttcccttctttctccggcagcgcgccggttggtatgtggggattcctttttctattatacactcgcgcgtcatcgaatcttgaacaaaaagaaaatattttgtcatgtaaagaaaaacaccttgacatcttgcgccgctccctgtataatacacagaagggaaatgtgtaaagcaatgcgctttacagaaaggagcaggatcgtggcgaagaatctggaaatttccgtactgcttgatttttacggcgaaatgctgacggaaaagcagcgggatgtcgtggaattgtattataatgaagacctctcgctttcagagatcgcggcacacagccagatcacccgccagggcgtgcgcgattccatcaagcgcgccgaaggaatcctgctcggcttggaggagcgcctcggcctggccaagcggttccgccgcattcaggaggggttggatctgattatccgcgatgcgcgcgatatccgaaattacaacgaccggttcggtacgttccgtgaaattacagataaaacaaacgagatcatcgaaattgcaagcacgatcaacgactgatcgcgatcaattcttggtcaaaagggggtggcgcagtggcgtttgaaggattgtccggcaagctgtcggcggtctttaaaaagatgcgcaacaaggggaagctcaaagaaagcgatatcaaggaagcgatgcgcgaggtgcgcctcgcgcttttggaagccgacgtcaactacaaggtcgcaaaggattttgtcgccgccgttacggaaaaagcggtcggggacgaggtgcttgaaagcctcacgccggcgcagatggtcgtcaagatcgtcaacgacgagctgacaaatctgatgggcgagacgggcgcgcgcttgaatttttcaagcaggccgccgaccatcgtgatgatgtgcggcttacagggttccggtaaaacgacgcattcggccaagctggcgctgcattttcgcgaacagggcaaacgcccgctgcttgtcgcgtgcgacgtgtaccgcccggccgctatcgagcagctcaaggtggtcggcgaaaaagccggcgtcccggtgttcgatatggggcagggcgacccggttgagatcgcgcggcgcgcggtcatgcacgcgaaggaccatggcaacgaccttgtgatcctggatacggccggccgcctgcacatcgacgaggcgctcatggacgagctgaagcggattcgcgacgaggtgtcgccgcaggagatcctgctcgttgtcgacgcgatggtcggccaggacgcggtcaacgtggcctcggcgttcgacgaggcgctcggcatcagcggcgtgatcctcacaaagcttgacggcgatacgcgcggcggcgcggcgctctccgtgcgcgccgtgaccggcaagcctgtcaaattcgtgggcacgggtgaaaagctcggcgacctcgagccgttttatcccgaccgcatggcgtcgcgcatcctcggcatgggcgacgtgctgacgctgattgaaaaggcgcagagcgattttgacgcgaagcaggccgccgagatggcgcagaagatgcgacagaacacatttaatttcaacgacatgctcgcgcagatgcagcagcttaaaaagatgggtccgctgtcgagcgtaatcaatatgctgccgggcgttgccggcaagctggacgacgaacaggcggagcagggcgagcgcgagctgcgccgcaccgaagcgatcatccagtcgatgacgcccgcggagcgcgaaaagccctcgctgatcaaccccgcgcgcaaacggcgcatcgcggccggcagcggcacgcgcgtcgaggatgtcaaccgcctgctgcgccagaacgagcagatgcaaaagctgttccgccaggtgtcgggcggcggcaaaaagggcaagcgccggcgtatgccgttcggcgggatgcccccgggcatgggcggcgggatgccgccggggatgccgttttaaaaggttcgccggttttccggcttgccgatagaggtttgtcaataatcataggaggtgacataaatggctgttaaaatcagactgagaaggatgggcgccaagaaagccccgttctaccgcatcgttgtcgcggattcccgttatccgagggacggcaggttcatcgaggagatcggtacgtatgacccgacgaaggatccctccgtcatcaaggtcgacgccgaaaaagcgaagaaatggctctccaacggcgcgcagcccacagacacggtcaaggcgctgcttaagatcgaaggcgtgctctgatgcacgtggaggtgatccgttgtggataagctgattgtcacgatcgcgcggggacttgtcgaaaacaaggacgccgtcagcgtcaccgtggacgagccgaacgaggaagggctggtggtttaccaccttcacgtcgcccccgacgatatgggacgcgtgatcggcaaacaggggcgtattgccaaggcgatccgcactgttgtccgcgctgcggcgaacagggccgaccagaaggtcgccgttgagatcgactgaaaaaaggggggcgcagcccctcttttttactatggaaacaacccatccgcgggatgggcgggcagaaggagcaagcatgaaaaaacagtatctggaatcggggaagatcgtcacaacgcacggggtgcgcggcgaggtgcgcgtacagccgtggtgcgatacgcccggtttcctcacacagtttgcgtgcctttatctggacgcgcgcggcagtcaggcgcgtgtggtggagcgcgcgcgcgtgcataagaatattgtcattgtcaaattcgagggcgtcgaaaacgtggaggacgcagcgggcctgcgcggaaaaaccgtctatatcgaccgcgcggacgttgagttggaagaaggggagtgctttgtgcaggatttgatcggctgtactgtgcgcgacgcggacacaggcgcggattacgggcaggtatacgacgtgcgcgccaccggcgccaacgacgtctactatctgcgcgacgcagcgggccgcgaacgccttgtcccggcgattgcggacgtggtgcttgcaaaggatctcgacgccggtataatcacgatccgtccgctggagggattgttcgatgattaagatcgatttggcgacgctgttcccggcgatgtgcgagacggtgctgtcggagagtatcatcggccgtgcgcgcaaggccgggtatcttgacatccggtgctttcatatccgcgattataccgtggaccgccaccgcaatgtcgacgacacgccctatggaccgggcaaggggatgctgatgcaggccgacccgatgtatcgcacctgggaggctgcatgcgaagcgcgcggcggccacaggccgcatgtgatctacatgtcgccgcagggcaggacgctgacgcagcagcgcgcgcgggagctttcgctgatggagcatttgtacatcatgtgcggacattatgagggcgtcgatcagcgtgtgctcgacgagattgtcgacgaggaaatttccatcggcgattatgtgctgaccggcggcgagcttggcgcgctcgtgctgatcgactgtgtggcgcggctttgcccgggcgtgctcgcggatgaaagctgctacgagcaggaaagccattgggacgggctgcttgaatatccgcagtatacgaaacccgccgtatggcacggcgtggccgtgccggagattataacgaatggaaaccacgcggcaattgcgcgctggaggcgcgaacagtcgctcaaaacgacgtatgaaaagcgtccggagcttctgcgcgccgcgccgcttacagaaaaagacaaatggtacttgcgcacgattggctggaccgacgatccggatgacggcagccggacgggctgaagcgcacgcgccctctttttcgacaggatgccccggctatgttgacataattgttgaaaactttatggttaagttgcacaatcgtgctttgaacgcctggcagcgtatctggaaaagcaacagaaaatacggccgggacaagaaagaaaagcaaaaattgttgacgctttcccgcaatccgcttataataatactaacacacaccaatcagatcagtttggagccgactcctggacaaatccaaagcgccgtttggcggagggggtttgtttatggatacgttccgattatggaagcagaggggtattgaaatgtttgtcaaagaagtcgctgttcagaaccaggttggcctgcacgcgcgtcccgctacgttctttattcagaaggcgaatgaatacaaatcctccatctgggtcgaaaaggaggagcgccgcgtcaacgccaagagcctgctcggtgtcctgtcgctcggcattgtcggcggcacgtcgatccgtatcattgctgacggctccgatgaacaggccgctgtcgagggccttgtcaagcttgtggagtccggctttacagagtaaaaccgtttgccgctgcctgccgcaaacggtccgcgccgcattgggcgcgcgccatgcagattcgcatgtatgtgtttgaccaaaaacccccttgccgggctgcggccccgcggagggtttttagtcgttccccgcacttttcggggacatgcggacgggcgcgtgtccggcggcgcgttttttcaaggcttgccccgccaaattttgatgggaggtggacgcaatcgacaatccgcgtctttcgtttctggccgaaaaggcgcgccggcttccgcttttgccgggcgtctacatcatgaagaacaaaagcggcgagattatttatatcggcaaggccaaggcgctgaaaaacagggtcagcagctatttccgcgcggtggaaaagcaccatcccaaggtgtacaaaatggtcagccatgtatacgattttgactccatcgtaacggacagcgagttcgaggcgcttgtgcttgaatgcagcctgatcaagcagcacacgccaaaatataatattctcctcaaggacgacaaaggatacagctacatcaaggtggcgcccaggcagtacgggcgtatcacgcatgtattccagaaggaggatgacggcgcgcagtatatcggaccgtatatctcctcgttcgttgtaaacgagacggtcgacgaagccaaccgcgtctttatgctgccgacctgcggcaaaaagtttccgcaggagttcggcaaggcgcggccgtgtctcaattatcatatcaaacggtgtatgggcgtctgtatgggaaaaatttcgcctgaagcatatgatgaaattttggagcaggcgctcgattatatccgcggcggcagcgcgcgtgctgtcgagcgtctgaccgagcagatgaatctgtgcgctgaaaacatgcagtttgaaaaggccgcgcagttgcgcgaccgtatccgggcggtgacgcgcatcagcgaatcacagaaggtcgtatttgcgaaggtagccaatcaggacatcatcgcgctcgcgcgcagcgaaagcgagacgtgcgccgtggtgctcaaattccgcggcgaacggctggtcgacaagcaggactttttgatcggtgcgactgatgatatcgacgccgcgcgtctggaatttttgctgcgctactatacgacgcggcgcggcgatctcccgaagaagattcagctcgacggcgacgttgcggatgtgcagcttgccgcgcgcctgctctccgagcaggcaggctataaggtggaaatccatatcccgcagcgcggcgaacagctccggctggttgagatggcgcgaaaaaatgccgtcgagcgcctttcgcagaccgtgcgccgcgcggggcgcgaggtgggcgcgctcgacgaattggcgaggctgcttgggctggaacgtccgcccgcgcgcatcgaggcgtatgatatatcaaatatcggatcggacacggtcgtcggcggaatggtcgtctttgaaaacggacgccctctgcggcgctgttaccggaaatttacgatcaagacggttgccgggacggacgactacgccagcatggcggagatgatcgggcggcgttttacacattataaaaacgatgagacgccggacgaggcgttcggccgtctgcccgacctgatattgcttgacggcggacgcggccatgtcggcgccatcgcgccggtgctcgagtcgatggggatcgccgtgccgctgttcggcatggtcaaggatgataagcaccgcacccgcgccatcgcccaaagcggaggtgagatcgccgtggcgccgcaccgcagcgcattcacgctcgtttccacaattcaggacgaggtgcaccgttattccatcagtttttcacgcgcgcgccatcagaaatcgtcttttgaattgtcgctgaccaaatgcgaggggatcggtcaaaagcgcgcggctgaaatcttccgtcatttcaagacaatcaaggctatccgcgcggcggacgtcgacgcgctcgccgcggtcaagggcgtgagccggccggctgctgaaaagctttatgaatttctgcatgcggatgattgacaaaatgaacgaaacaggcaataatatgcatacaagaccgcccgccgagggcggttcagacgggaggaacggctatgagggtgatcacgggtacggcgcgcggcacgcgcctggaggcccccgaggggcagcagacacgccccacctcggacatggccaaggaggctgtgttcagcatcctgcattttgaattggccggcgcggctgtgctggatctgttcgccggcagcggacagcttggcatcgaggcgctctcgcgcggcgcgaaaagctgtgtgttcgtggaccactcgcgcgctgcgcaggaggtcatccgccgaaaccttgcggcggccaagctcacgccgctcgggcgtgtggctgcgatggacgcatcgtcctttttagcgggatgccgcgaccgcttcgatattgcgctgctcgacccgccgtatgacggcggccagttggaaacggcgcttgcgggcgtggccgcgctgatgaacgacggcggcgttatcgtctgcgagacggaccgccgggccgagccgccggccatggtcgggacgttttgtatacaaaaggcgtaccggtacggccggacaaaaatcacgacctatagaaaacgacaggaagaagatgactgatatggagcgtctggcgatctgtccggggagcttcgacccgattacaaaaggacacgaggacatcatccggcgcgccggaacgctgttcgaccgggtcatcgtcgtcgtcagctccaatccggataagcggccgattttttccctggatgaacgcgtcggcctgatccgggatgtgtgtggcgatatgccgaatatggaggtcgataaattcagcggccttctgattgattatgtgcgcgcacataaagcggttgcgattgtgaaagggctgcgcgctgtttccgacttcgactatgaatttcagatggccctgacaaataaaaagctgtatccatacgctgagacggtttttttgacgccaaacagcgataatatgtatctaagctccagcatggtccgccagattgcgcggtttgggggcgatgtcggcagctttgtgccggcggcgatcctcgatacggtgacagaacgcctgcgcgcgcagtatgcggctgttggaacaacgagtgagtaaggaggcgtttccccaatgaatatcgatgagattctggacgtgatcgacgagctgcttgaccgcgcgtggagtctgccgctctcaggcggccgctgtgtggtggatgcggataaggtgcgcgacctgatcgacgatatccggttgaatattcccggcgagatcaagcaggcgaaggcgatcgtatcagaccgcgccgagatcatcgacggcgcgaaaaaggaagctgaacagatcgtgcgcaaggccgaggaccgcgcccgcgcgctgatcgcacagcaggaggtcacgaaggccgcccaggccaaggcgtccgagatcctttcccaggcacagatcaaggcgcgcgagatccgtcaggccgcgcaggaattttccgacaactgcatgctaaagaccgaggaagtgcttgtcaagtccctgaccgagatcaaagcgacccgtcaggcgttccgcaacgctacatcccgataagcttccagccttttttcaaaaaggcttctgcgaaaaactttccggcctttttgaaaaaaggcctcggcgaaaaactttagtcggctgcgccgcgaacagcggggcagattccagtatttttacaggctgcgccgcgaacagtggagcgggcgccgcgcgtatacaggctgcacctgccccggagttgggtccacgggacaggggcagtttgacggtttaccacaggacgcaccggcgtgcgcccgatacgatcgcgccaaacagagacggggataacataaggggagggtcgccggccctccccttatgaggcgcgaaaaggggcgcagctgcggcttgtccacgcccggcgcgatagcgccggaaagctccgaatagccggccgggcaagcgcagcgtccggcggtgagcaatccacgcacggattgcgcgcgcccccggcggtgagcgagccgcgtacgagtcgctcacgctagcgcaggccgcaagagcctgttcagacgctgccgtttccactggcaaaatccatgactaacgccgcacggccggcgtggattttgcagtcgcccgccttccggccatttcaaaatatgataccatgcagcctaagccttgtcatgcatttatttaatacagctgaataagaacatttgttctttttgtggattgcatttttttgagtgatcgtgtataataaccgcagggcggttattataccgggctatgtttagggcgatacgcgggcgcggcccgctgccgcccgatggacaattgtacaatgccgctttcgcggacattatataatatgcgcagggtaaacggctttgccgtttgcagccgccattcggcggcaaccgctgcgaaggcagcgggttgcgcatgggacaccacagccgaaaccagcaattccaaaagggtttgctgctgtggtataatatgggtattacatacggcggaggtcacatgcatggcggataaggacaaaaagctcggttcagtaagcgcacgcaagagcggcgtctcgtccgaggatcggaaaaaggcgcttgagactgcgcttggccagattgaaaagcaatttggcaagggcgcggtgatgaagctcgggcaggacagcacgctcaatgtggaggcgatctccaccggctcgctgtcgctcgatatcgcgcttggtatcggaggcgtaccgcgcgggcgtatcatcgagatatacgggccggaaagttccggcaaaacgacggtcgcgctccatgttgtggcgcaggcgcagaaggaaggcggctcggctgtattcatcgatgtagagcatgcgctcgacccggtgtatgcgcaggcgctcggcgtcgatatcgactcgctgctcgtttcacagccggataccggtgagcaggcgcttgagatttgcgaggcgcttgtgcgctctggcgcgatcgacgtcgtggttgtcgactcggtagccgcgatggtcacaaaggccgagattgagggcgatatgggcgacagccatgtcggcctgcaggcgcggctgatgtcgcaggcgctgcgcaagttgactggcgcgatcggcaaatcaaactgcgttgtgatctttatcaaccagctccgcgaaaaaatcggcgtcatgtacggcaatcccgaaacaacgcccggcggccgcgcgcttaaattttacgcgtcggtgcgtctggatgtgcgccgtgtcgaggcgctcaaaaacggcactgagctgatcggcaaccgtacgcgtgtcaaggtagttaagaataaggtgtcgccgccgttcaaagaggctgagtttgatatcatgtatggcgaaggtatctccaaggtcggcgaaatcctggatcttgcgacaaagctcgatatcgttgtgcgcggcggctcgtggtttaattacggcgaaacgcgtctggggcaggggcgcgacaacgccaaggaatttttaaaagccaatccggaaatcgcgcaggagattgaaacaaaggtgcgcgaaaatgccgacaagctgttgaagactacgaaaactgccggtaaaaagccgatgcgcgccggtgcttcggccgcggagccggaaaagctttccgccgcgccggagacgccgcccgcgccgcgcgtcaacattgacgtggagacggacgacgaatgacgctgactaaaatcgcgatgacaaagcgcggccgggtggcgctgtatgccgacggcgcgtttgtgatgagcctgcaccccgatgtctttgcggcatcggggatttcggttggttcacagattgatgaggacgccctgcgggagctgtcggacgcggcagagctgcgcgaggcgcgcgaacgcgctctttcgatgctttcacgccaggattatacggcgcgcggtctgcgcgaccgcctgacgcggcatgtgagtgaagaagcggccggacaggctgtggagcgtatgcaggagcttgggctgatcgacgatgagcgttacgcggcgcgtttcgcacaggagcttttagagcgtcgccattatggcgcggcgcgcatccggcaggagctgcgccggcgcggcatcgattcgcagacagccgcggcggccgcctctctggaggaaaatgatccgcaggcgcatattctggcggtgctggaaaaaaaatatccgcaggcggccggggacgaaaccgtccggcggcgcgcctggggcgcgttgctgcgccttgggcacagcccttccgatgtgcggcgcgcgctcgacgcgttctgcggtgggcgcagcggatttgatgacgattgacgacataatttgacacggggcggcgcgcctgtttgcgttgcttcggttgctgcaaaggagctggctgcatgtcggtaaaggtcgggatggtatccctgggctgttcaaaaaatcaggtggacgcggagcggctgctcgcgcagattgaaaaaggaggctatgaaatctgcaccgacgcgtcgcaatgcgatgtggttatcatcaatacatgcggcttcattgaggatgccaagcgtgaaagcatcgaaacgatcctggagtttgcgcagctcaaaacgggcggcgcgctccgggcactcgtcgtaacgggctgcctggcggagcggtatcgcgagcaggtggccgcggaaatcccggaggcggacgtcgtactcggcatcggctgcaacgcggacattctcggcgcgattgaaagggcgctgcacggtgaaaaaacggtggcgttcggcgagaaggaggcgttgtccctggaaggggagcgcgtgcttgccaacgagccgtattttgcatatctcaaggtggcggagggctgcgacaaccgctgttcctactgtgcgattccgctgatccgcgggccttttcgcagccggccgatggagaatatcgttgcggaggcccagcgccttgcggcgtgcggcgtcacggagctgaatgtcgtggcgcaggatacgacgcgttacggcgaggatctgtatggacgtctggcgctgccggaacttctggaaaagctgtgccggctggacggcgtgcggtgggtgcggatgctgtactgctacccggaccgcatcacggaccgactgctcgacgtgatggcgcgcgaggaaaaaattgtaaaatatatggatataccaattcagcatgtaaacggacgtattctgtcgctgatgaaccggcgcggcgacgccggaagcctgaccgcgctgatggaaaaaatacgcgcgcgcgttccgggcgtcgtgctgcgcacaacgctgattacgggttttccgacggaaacgcagggagagttcgaggagctgtgcgaattcgtgcagcgtgtacgctttgagcggctcggctgcttcgcctattcggccgaggaagatacgccggccgcgttgatggacggccagctcgacgaggaggaaaagcgccgccgcgcgcagattattatggaacagcagtacggcgtcatggaaggcttcaaccgttcgcagatcggacggcggctgaccgtcgccgtagagggacgcgagggcaggctttggtatgggcgcagctatatggatgcgcctgatattgattcgcgcgtctatttttccggacatgggccgtacagcccgggcgattatattgaagttgagatcgacggcgtggaaggatacgatttgaaagggaaggcgctgaacaaatgaatttgccgaataagctgacagtcatgcgcatggcgctgattccggtgtttctcgtttttatgctggtggagtcgatcccgcaccgctatctgatcgcggccgtcatctttgccgccgcgtcgtttaccgattatcttgacggacacatcgctcgccgcgacggacttgtcacaaatttcggcaagctgatggacccgctggccgataagctgctggtgttttcggcgctcgtctgcttcatcgagcttgagatgagttccgcgctcatcgtgttcatcattctggcgcgtgagttccttgtgacttcggtgcgcctgatcgctgccgagcaggggaccgtgatcgccgccgatatctggggaaagatgaaaaccgtgtcgcagatcatctgggtgctgatcgctctgattgcgctctggctggaggagagctggccgcttttcatgacagtctcccccggcgcttccgcgccgcccgcgccggtgatctttctgatcggcctgtcatttgtcatacagacaatcgttgtgatcctgacggttttttcaggctttaattatatctggaaaaaccgttcgcttcttggcgatatcaaataacgcttgcatccgcgcttgtgttgtggtatcctcaggttggaattgtttatgcacagaccgcctgccggccgcatagactgtatagcataaatgcgttgatcgggagaagtatccgcgaagccacgcgacagagaagacgcgccgaaacgccgcgcccgcccaggcgggacggcgccgggctgcaagcgcgtcccgcgcgggccgcggcgaaatgcgcccgtgagcacgccgtccgaacggtttatatccgggtggggcggcgcgtttccccgcgttaaggggtatggggtggacgcccctgagtgataaaccgaagtggaaccgcgggaatgccgccttcgtttggccttgggccggacggggcgtattttttttcctaggggctgtttgaaaaatcggaaataccgtctttttctacaaacagcggtgaatccagcgttaaaaagcctcggaatccgaaagggttcctgtgttttttgccttgtattctcctgctgtctgcgaaaaatccggcaattcctctattttcaaacaagccctaaagacgggcttaaaaaatattcccgcgcattcatgttcttctccaaaggaggtatcataaggatgtttgacgaactgaaaaaggatatacaggcggtcaaggagcgcgacccggccgcgcgcagcagccttgaggtgctgctgatctcgagcggcctgcacgcgctgatgctgcaccggccggcgcattggctttaccgccacaaggcgtttttgcccgcgcgtttgatcagccaggcggcgcgctttttgaccggcgttgaaatacacccgggggcgaaaatcggctccggcgtgatgatcgaccacggcatggggattgtaattggcgaaacggccgaggttggagacggctgcaccatttaccagggcgtgacgctcggcggaacgggcaaggataaaggcaagcgccatccgacgctcggcaaaaacgtcacggtcggctgcggggcgaaaattctcgggccgttcaaggtcggcgacggcgcgaaggttgccgcaaacgcggtgctgctcgaatcgattccggcgcagtcgacggcggtcggcgtgcccgcgcgcgtggcgcgcgtcggcggacgaaagccaacgacgcttgaccacgttcacattcccgaccctgtggcgcaggagatctgccgcctgcgctttgaaatcggtaagatggagcagcgcatccgggaattggaaaagaaggagcaaaaacaaacgcaggcgcctatccatccgccgcagacagccgcggcggatgagcggtaaaacgcgcacggggcctgcgccccgtgtacatactgcgcgcggcatgggcctgacagcgtgcggccaggatgccgcggaaatcccaggtcttgccggtcagttcatttaggaggaaaagatatgaaaatttttaatacattgacgcgtcaaaaggaagaatttgtcccgattgagcctggaaaagtcaggatgtatgcctgcggaccgaccgtttataattatatccacatcggcaatgcgaggccgatctgcgtgttcgatacgctgcgccgttatctggagtatcgcggatatgatgtgacgtttgtgcagaactttacagacatagacgacaagctgattaacaaggccaacgaggagggcatcacagtccgcgaggtcgccgagcggtatatcggcgaatatatgacggatacaaaggggcttggcatccggccggccgatatccacccacgcgcgacggaaaatatcgacacgatcatcaatatggtcaaaacgcttgaggagaagggctttgcatatgagcgcgacggcagcgtttatttccgttcgcgccgctttgaggagtacgggaagctttcgcatcagccgcttgaggagcttgaggcgggcgcgcgcatcgacgtcagcgacaaaaaggaggacccgctcgatttcgtcctctggaaagccgccaagcctggcgagccgagctggccgtctccgtggggcgagggccggccgggctggcatgttgaatgcagcgcgatgatccgccgtcaccttggcgatacaatcgatatccactgcggcggccaggacttgattttcccgcaccatgaaaatgagatcgcacagagcgaatgctgcacaggcgccgagtatgtgcattattggatgcataacggttatatcaacgtggataaccgcaaaatgagcaaatcgctcggcaattttttcactgtgcgcgaggtggcggagaaatttggctatgagccgatcaagttcatgatgctccaggcgcattaccgcagcccgatcaattacagcctcgaggtgatcgaacagtgccgcgcggcgctggagcgcctgcacaactgccgcgacagcctcgatttcgcgctcgaaagcgcgctcgggcaaggggactggcacgcgttcagggagaagatggacgcgcgcgccgcgcagtttgtcgaggcgatggacgacgacttgaatacggccgacggcatcgcggccttgtttgaaatggcgcgcgatatcaacacatatatcgcacagccgcagccggaggaggctgtcgcttatgcggtcaaacggtttgacgagctgtgcggcgtgcttggcctgctttataaccgcgcgtcaaaggatctcgacagcgaggtcgaggcgctgatcgccgagcggcaggcagcgcgcaaagcgaaggattttgcccgcgcggacgcgatccgagatcagcttgccggaatggggattcttctgaaggatacgccgcagggcgtacagtggagcaggaagtgacggcggtccgcgcgctccctgtcggaaaatgcgcggcgttggggcgcatggaggcgtgctgaaaggcccaaacttgtatggagggccgtttaaaagagcaaagctgcacaagggctttataaaaacaagtcctggaggctgaaaggagaacagcatgcgttttgaacgaatccgcgacctgcgggaggatcgcgatttaaaccagacggccgtagccaactatctggcgatcgatcaaccgggatattcgtgctatgagcgcgggatacgcgacattccaattgagattttgatgaagctggccgatttttatgagacgagcgtcgattatttaattgggcgtaccgacgtttacaggccatatcccaaatcgcatctgttatgaaccgtgcgtttcataccggcgcaatcgcctgggcatgcgcggcatttctgtcggtatcgtttggagccgatccgcgcgcggcagcggctgttggagcgttcatgctgctggcggctatcgccgtgagaaaaaggctgccgttgtggctttgcgccgcgacggtagcttttggtctttctctggtatggctggcgctgcacagcagcctgacgttttcggccgccgcgcgttttgaaggcgtttcagtggatttgcgcgggttggttattgaacgtgtggaatatggcgattatgcgcgtctgacgctgatcgcggaggacgggccgctgccgtcaggaattcgcgtgtcggtcggggcgcccggcgcgcttgatgtttcccccggcgatgtggtagaatgggaactgataacggacaggcccgatgcggcgtcgcgggcaaagctctatgcagacgcaatcgggcttgaggcatccatggccggcgcgccgcggctggttggaaaacgtccgaacgactggcgcgtcctgttcgcccggtaccgcgacgcggccgcttcgcatatcacacgatatctgactgggccggagggcggcgtgctcgccgcgatggccacaggccgcagcgagctgatcgctgcggatctccgcgcagattacgcccggtcgggcctttcgcacctgttggccgtatcgggactgcacctgaccgtgttcgccgggctgttcgacgcgcttttgtcaatcgtccgctgcggacgccgcatgcgcgcagccgccgggctcacggccgtgcttctctttatgctgatgaccggctgcacgctttcggtcgtgcgcgcggccgtcatggctgtgatctgccgcacggcgctgctgctcgggcgtgattcggacacgcttaattcgctaggattcgctctgatcatcatcctgctgcaaaatccatacgccatattcagcacgggcttgcagctttcctatcttgctaccatggggatcgccgcctgcgccgatcccgcctgcgcgtggtgcgcacgctggatttggcggatggacgcgcgcagcctgcgccggctgcacccattgggttatgcggcgcttctggccttttcaacctcagtctgcgccggcgtgtttacagctccagtgctttgctttgcattcggacagctctcgcttgttgcgccggttgcgaatgtgctggccgctcccttcgtaacgcctgcgctggcgggcggtctgctctgcggcctgctcggctttatcccaccgcttgacgttgtggcgcgcgcctgcgcgctggccggcggcgcatcaattcgtgtaatcaacacgattgcttcctggtggggcgccctgccgtttgcgtctgttccggtgcgcgccgggcttgtgacgctttggatgggcgcctgtattctgggcggcgccctgctcgcggcaaatcgtgcgccgtatgcggtgcgtatttatgcggcgtctcttgcggttgtggcgctgctgtccgggatgctggcgcatgccatagcatggggaccgaccatggaactggctgtttcgcagagcggtacaagcgtcgcgcttgcctgcggcggacagggcgctgtgatcggggagccggagtctgtctcggatgcccagaatttggctgcatttttaaaggacagcggcgtgaagcgaatttccctttatgctgtgcaggaggagggcgcgcttttctccaacaggacgcacgcactgtcaaaaattcttccggtcgacacagcgttcggccttgaccggacgcacggctttgcggcagagctgcccggcgcgcgcatttcggccgaggggaaggatgcggagagcatttcgattgagatgggcgggcttcggattgtcaagacgtttgaccagatacctgcggccgccgacgtgctgatcaacgcgcgcggacagattgtcgccgcgcccggcgtcatgctgaaaacaaccgcgcgctattacaactgtgaaatcttgacgctgcgccgcacaggcgcggctgcgctggacgtgataccgcacgccgcggcgcgtctgacggagggaacgccttgaaatatacgatggaaagcgattttgcaaagcatgtcaaaagcagcgagcagcacaatgtctacctgctttacggcgggcaggcatacctgatcgctctttatgaaaaaatgatagtgaaaaaggcgcttggcggagcggatgaagcgttcaatttgcgccggttcgacggcgatacgctcgatttacaaacgttttacgatgcggtcgaatcggtcccgctgatggcggcgggctgctgtgtgacgctttcgctcgatccggaaaagctcgatatgagccgaatgaaggagctgtgcgccgtaatcggcgacccgccgcagacgacggtcatcgtcgtcacagtcaaggagccgcccgcacgccgggaaaagatgaatctgctcatcaaggcgtgcgacaaagctggctgtgtggtcgagcttggcagccggcgcggcgcggacacgctgcgctttctgcgcgaccgtgcgcagaaaaacggctgcacgctcgaaagcggcgaagcttcctatatggtcgaacgctgcacggacgatttacagcttttggccacggagcttgataagctgtgcgcttatgcgtccggccgcaaaattacgcgcgcggatatcgacgccgttgttacagtcgttttacaggcgcgcgtattcgatctgtccaaggcgattctgcgcggcaatttccccaaggcgatggagctgatcagccagcttgacgatttgcgcgagccggctgcgcgcacgctgtcgatcctgtcgggcgcgtttgtcgatttgtaccgcgggtttgccgccaggcaggcgaacgtgcccgccgggcgcgcggcccctgagcttgggtatgccaaaaaccgggagtttgcgatcaaaaacgggatgagcgacagcggcgcgtataccgccggacagctcggcgcgatgctcgaggcgctggccgaggcggacctgcgcgtcaagagcagcggcggcgacgaccgcgtcgtgctggaggaaacggttgcaaagctctttttgatcggcggtcgtcagaaatgctgaggatacgccaggctattatcgtggaagggcgctatgataaggcgaagctgcattcgctcgtcgatgcaaccatcgtgacgaccgacggcttcggcgtgttccgcaaccgtgaaaagctcgcctatatccggcgtctggccgcgcagaccggaatcatcatccttaccgactccgacgcagccggctttcgcatccgcggctttctggcgggcgcggtcgacccgtcgcaggtgacgcatgtctacatcccggacttgtttggaaaggagcgccgcaagacgcagccttcggcggagggaaagctcggcgtggagggaatcccggcccagacgctgctggccgcgctgcggcgcgcgggcgtcgctgtggaggaaacgtccgcgccggccggcgcggggaaggcgtcctctgcggacgccagcgcgcgccggctgaccaaggccgattttgtggcctgggggctgtccggaggggcggacagcgccgccaggcgccgcgcgctgctttcgcggctcggcctgccggagcgtatgagcgcaaacgcgatgcttgccgccgtcaatgcgctgtatacgcctgaggaattcgaacgcctgcttgccggtatgccggaggaaaagggaacgcattgcgatttttcggatcatccaggacaacaataaaccaaaggaggtcgccaagcgcgtgcagatttacagcctgtcgtttctctatttatttttgccggcggccattttattgtgcctgtttgcgccgcaccgtgcccgcgcggcagcgttgcttgcagtgtcgggtgcgttttatgcgatgctggagggcgacaatctgctgctggcggcagcggtgattgccttcgattacggtatggggcttttgatggagcgcagcgcgtcctttgcgcgcctgcgccgtgcaattatgatctgttcagtggtcaaaagccttgcgatccttgttctttacagtctggcgcaagagatgacaggcgcgcacagcccatttgggctaggcgtcatctgcctgacctcttgcggatatgtgatggactgttattttggttatacgtattgtgaacacagcctggtgcagcttgggctgatgacgctgttttttccaaagctgtatgccggaccgctcgtctatcacagtaaaatagtcccgcagacgcgctcgatgcgtatgacccttgaaaaaaccggcgagggcgcgcggtattttttgcagggtctggcgaaaaaggtgctgattggcgacacggtttacaggctctatgagacgctgcgtgcgctgccaatggccagtgtgacaatggctgctgcgtggacgatggtcgtgacgctggcgttttcggtctattttatcctcgcgggtttttgcgatatggcgcgggggcttgcattgatctttggtttcgagcttcaggataattttcatgcgccgtttggatctaccggcatcaacgactttttttcacgtttcaatatcacagtcaaccgttatgtgcgccgctatgtttatatcaatcttggcggcgcgcagggcagcgtgatttcaggcgttttcaacatcctgctggttacgattctgatggggctatggtttagcatcagcctcaacctgcttttgtggggcgtttatttcgcgctgtttgtgatctttgaacggtactgtctgggccgccgcattgatctgattccgccgctgttgcgctggatttacagcacagtggtaatcatggtttcattttgttttctagcgggcgatacgccggggcaatcgatttcttacctgctgcgtctgttcggtctgcgggggaccatttcgccggaaagtggaagcagcatcctgtatctgttggcttcgaactaccttgtgctgctgatagcggtcttttcatcgaccggcctgattgaacgggcggccaaggtgatttataagcatgcgccgcggctttactggtttgggacggcggtgctgacggcggcgctgctcattgtgacaacggcgtttcttgtatagaggctgattgaaaaatcaaatgttcgtctattatcaaacaagccctaaaaaggtttgaccggctttgaaaggaggcggaagcttgcttggtaaaaaattgacgggaacggtgtttttgctcatgctgttcgcggttccctgtctgatcgcggcgggcggcggggggcgcgcgcttttgcgtgccgccggttcgatttacgcgccgctgggcaagctggaaacggcgatggccgaacagttcccggcggccgaccggctgcgcaagctggaggtgtccttaagctacatgggcgggcagaaggagcaaaacggcgttttcatctccggcgattctctgacgcttgatgtgcagccaaaaagcctgtcggtcatcaacggcaatacgcttgcaatgatcgattttgccgatgaacatcaaataccaagttatgtcatgctgatcccgacggcatgtgccgtccagcagggcaaggttccctatgacaaagtcgcgccgctttacaaccagcgccaattgatcgacgacgtataccgccgcgtatcaggccatgttaccgccatcgacgtttatccaacgctctttaatcatcaggatgaatatatttattataatactgacaacacgatcaccggcttgggcggatattatatttatactgcggcagccaaaaatttgctgcgctccaacccgcgcgggcttgaccaatacgaagtggagcatctggattacaattattacggcgatctgtatgcgctgtctccttaccgggaggtttcagccgaccgtgtgtcggtatactcctatgtgtcgcgttatcagcgcgattatatcgtcacgcattacgacgcttccggtatccgccggtattatacgctgtatccgcgctttcgggcggagcttgacgattcgatgggggtcgtgcttggcggcatgtcgccggtgatcgatatcagtatcatcggcagcacgacaaacagcaaacggctgctgctgtttggcgaccggtcggtccagggttatctgccgtttttgcttgcccattatgagcgcgtcacggttgtcgatacaactcaggctgcacccgagcagctcgacaggatcaatctgcgcgattacagtcaggtgctgttcgcctggtccgtcgaccactatgttacagccgatcagctttccttattggacagccttggcgcggcgcaggaagcttgaaattgcgcgcaggccgccctgcccgcgcgcgggatatttcaaaagagacggggaaaaatatgaccggtatgggagattttctccgcgttttcgtatgatgtaaggtccggtcaggcaaactggcttgctcggaccttgtatcaaatcatttgggaggcttccgctttatgaaacaaatcgccgcactgcttcttgcagccgttctggctgcttctatggccgcctgcacgggaagaaattcgttggcaacgtcctcggcgctctccgaaggggcggcttccgccgcgacgtcctccgaaccggcgccgcaggcatccggcacgccttccgagtcgctgctgtcatcagcgccgcagacggacagggcggggctggagcgtactctgtatatcggcgccggcgcttcaatgaaggaatatccgtggacttttgaaagcgatccgtcgcccgacgatctgattgccgccatcgccgagatgaccggatggaacctgacgctggccgaaccggtcagcagcggccgcggcggcatgacggttgtttttggccgggaaagctctgttttcacaggtccgcccgatccgcagaaggatgaattccatgtgttcgatacgcaggatctggtattccatatccttgacagcatccagaaaaccttgcagatgaacacgatcgatccggcgcttggcgatccggacaaccttgatatctatttttcgacggaggacggagctatatcgctgcccgacgtggggattgaaatcccgttggaggagccatatccgggttctgccgcattgtctgaaacgtatgcgcagagctgatcagaacgaaataaaacgctgtgggcgcattccatttggaatgcgcccacagcgttttggtgtgatgcatacgcaggatatgtgccggccgcgcatatcctgcgcaatctaaaaataagagagaaatgaaaagcaaacaaaagcttattaacaggtttgaatacaggttcttaaacaagctccatatccatcacagccttgatctcagaaccgccgtcgcgcagcgactgcataacgggggcgatctcattcattgcaaatatgtgtgttataaattgctttggatcgatcacacctgttttgatcagatcggtgcacatcgggaaataaagcgccggagctgcgaaggaagcgcgcagctacaactttttaaagtgaaacgcattggcgtcgaaggtgatcatcggaaccgcagatgccgcacgctttgatcctgagcaggacctccccggcagcaggctgcgggatggggatttccttgattttaaactgaaaaggtgctttgacaaaaacggttttcatcatacgttttgatcagtcctttttaaactggtcgatcacaactgcgatcaggatgattacgccgagcgtgatggtctgccagtaggaggaaacgccgagcaggctcagagcgttgttgatgacgccgatggcgacaaggccgaatatggtctgaatgatgccgccgcgtccgcccgacatgcttgtgccgcccatggcgaccgccgcgatggcgttgagctcatagctctgcgcggcgtttggctggccgctttgcagcttggaggaaagcacgacaccgccaagcgccgcaaggatgccgcagatgatatagacaaggtatttgatcttcttgacattgataccactgagcttcgcaacttccgcgttgctgccgaccgcgtagatatagcggccaaaacaggtgcgagacaggatgatgtaagccgcggccagcacgatgatcatgacaatgacagtaacgggaatcgagccgatgctgcgcaggccgacccagccatatgaatcgggaaggtcaaagaccggcttggaatctgtatagacaaaggcaagtccgcgtgcgatgttcatcattgcgagcgttgcgataaatggcgggacattgagctttgcgacggaaaacgcgttgatcgaaccacagataccgcccacgacgattgcggcaagcagaatcacaagcacgctcagcccgcgtcccgcgtccgggaacatcttgatggtagctgttgcgacaacaccggccaaagcggcaacggagccgaccgaaaggtcgatgccgtcggacaggataacgaatgtcataccggtggcgatcagggcgttgatggcgatctggatcaaaacgttcatcaggttgccgggtgtggcgaaccggtcgacaaacagcatacatgcgatgaccagcacaatgacgaacaggagcatggtatattccttcgcgaacttgcgcaggccgcttgctgtgacattttcttttgtattggaaagtgactgactcattgattacacccctgtttccgtttcactgttgaagctggcgtactgcatgacttctttttcggtcgcgccctcggcgttcatgatttttgtgacaacgccgccgcgcatcaccatgatgcggttggagactccgagcacctccggcagctctgaggaaaccatgataatgctgccgccgttttcaacaaactccttcatcaaggcgtaaatctccgccttggcgttgacgtcgatgccgcgcgtcggttcgtccataatcaggatacgcaccttggcggccaaccacttggcgataaccaccttctgctggttgccgccggagaggttgcgcgccagcgcccggtcggacggcgtcttggtgtgcagcttttcaatgtattccgccgcaatggtgttttcccatttgaaattgataaagccatggtgtgaatttgccatcaggctggcaagcgacgtgttctgccgcaggttcttttccagcagaagcccctggccgcggcggtcctccgggatcagcccgatgccggccttgatggcctggcccggcgttttaaacgcagccttttggccaaacacctcgatctcgccgcttgtaaaacggtccgcgccgaagatggcgcgcatcacctcggtgcgcccggcgccgatcaggccggaaacgccgagcacctcgccctgatgcagatcgaatgaaacattttggaaaacgcccttgcgcgtaaggtttttgactgaaagcactaccgggctgtccttgggcgcttcggccttgtaataatactgcgtgacctggcggccgaccatcagggcgatcatcgtttgttcgtccgtttcagacagcggcattgttttgaccacctggccgtcgcgcaggatggtgatattgtcgccgatttcaaagatttccttcatgcggtgggagatataaatgacagcgacattttcgcttttgagcttattgatgacgcggaacagcgcctcaacctcatgatctgaaagcgaggaggtcggctcgtccatgatgaccatggagctgttctggctgacagcgcgcgcgatttcaaccatttgcttgtctccatttgtcagcgtccggatcaccgcgcgcggattgatcttgacgccgatggaatcaagcagcttttttgtttcagcgaacatggtcgctctatcgatcaaacctgtcctggcaattttcggttccctgccaagaaagatattttctgctacagttaaatcggggataacgctcagttcctggtggatgacgctgacgccgtgagccagcgcctgccgggtatttgtaaacgtatattcctgaccgccgacaagcagtttgccggcatcagcctggtaaacaccggaaataattttgatgattgtggattttcccgccccgttttcaccgaggaggacatgcacttttccgggataaaacgcaatggaaacgtcagacagcgccttgacgccggggaaggacttgctgatatccacaagctccacaaaagggttcgtgttcactgtttcactcctctgccaaagttttggggcgtcgtttgccggcagccccgtgtcgcctgaaaccgccggaaggccggcggggaaggggacccttccccgccgccggcatgtggaaaatgaaaggaataattattcagcgttggaagcgtcgatgatgtacggggcaatcgggatgttggattcaacctgggcgccgccgaggtaatcgacaactgtctgaagggtggtttcaccgatcgcagtcggatcctgcgcgacgtcagcaacccacagaccaccggatttgatcgcgtcgataccctcgggattgccgtcaaagccgataaccttgcactggctgttggcggaggtgatggaggccatcgcaccggtagcggccgggtcgccgacacagaagacagcggccaggtcaggggtcttaagcagcatgttggccatcacatcggcggccttggactggtcgccggagtagttctgaatgtcggcgacaacaacgtcgggagcattggccgcaatccagtcggtgaagcccttttcacgctgcacgcagctttcgatctcggaataggtgatgacgccgacgttgcccttcttgtcggtcagcatgttgttgaccatgtactcggcagccagctcgccgcccttgtagttgtcggtcgcgatgtgcgcgacggtttcaccgtcggaagcgatatccatcgtgaaaaccgggatattcgcggcggtggcaagctccaccatcgacttgctgcctgcggagttggtcgggcagataacgatggcgtcaacggcctgggtgatgaagtcctgaacctgactgagctgcttgttcgcgtcgccggaagcatcctgaacgatcagctcgacattcagctccggagccttggcgaccatggcagcctcaatgttgttgtagaaaacatgctgcttgttgagcaggctgacgccgacacggatcgtttcgccggaagcggcgggtgtggaagcgccggttgaggctgcggaagaagccggggcagccgcgtcggaagaagcgggagcggccggctcactggccgccggagcggatgatgtggttgtgctgcttccgccgcaggctgcgagcgaaatgcacatggcagccgcgagggctgcgccgagaatgcgtttgaacatagttctttcctcctaatgactctgtttcagagttttctcaagcctgcctgaaaaaccgggaatcaccgggccgcccgcaagcggttatggccgcttgcggggcggatgcgtttccagccttccacacatgcttattttaatcaaacggcttttgccgtcgattacgctttaccctggctgccgcagacggtgatcttgtgtttgacaagctccaccacggcggcgcggccagcttttccgtagacctttgggtcaaagaccgaggcgtcgtttgcaagcaccggccggacagccttcgtataggcgtcacgcagctcggttgcaaaattgaccttacaaatgcccaagccgattgttttctgcaccgcctcgtccggaacgcccgacgcgccgtgcagcaccagcgggacggaaacaactttgcgtatttcagcgaggcggtcaaaatcgagccgcggctcgcccttgtaaaagccgtgcgccgtaccgatggcgactgccagcgaaccgacgcccgtgcgctcgacgaattcgcgcgccttttccgggtttgtgtacatcgcgtcggcgtcgagcacgacatggtcgtcctccttgccgccgaccgtgccaagctcggcttcggtcgggatgccgcgctgcttggccatcgcggctgtcttggcggaaacagcgatgttttcctcaaaggagagcttcgaaccgtcgatcatcacggatgtatagcccgcgcaggcggcctgctcgcacagctcatagctgctgccatggtcaagatgcatcgcgaccggaaccggggcggattcggccagcgccgcgacaatcgcccggtacacggacaggcttgcatacttaaccgtggacgaggtggtctgaatgatgaccggggcgtttaactccgtcgcagcctggataacagcctgcgccatctccagattctccacgttgaaagcgccgacagcataatgcccgtcctgggctttctttaagaattcagttgttgtaacaagcggcataatgattcccttctttaaaaacagttgtgtatagtcgatatggttttcagatctctctgacggagatcagttccatcatctgtttaaaatcctcaggcatacacatctgcgtaccgtcgtggatcagcgatccgtgcgcgaccgctacgccataatgcagaatctcaggctcgctcacgccgtccagaatcgccatacagatgccggagacgagcgagtcgcccgcgccctgtacaccgcgcaccggcacgtcggcgccttcggaaaaccacgcccggtcaccgctgacaagcagcgcgccctccttgcccatagaaatgcagacgtatttgacgccgttttccacgatgattttgcgcgcgatggcgatggaatcatcgagcgaatggattttgcagccgaaggaagcttcaagctcgtcgcggttgggcttgatcagaaacggcgcagacttaatgccctcggtcagaagcgggccgtaagcgtcaagaatggcttttttgccgtacgcgtttgttttttcaatcatacgcttataaagatccgacggtacacccggaggcgcgctgccgttgatgaccataatatcggaacgctctatgtacgcgtccattctgttcatcaaagattcaacgtcctcggccgaaacaggcccgccgccttcgttaaactcggtcatgacatgcttatcggcgtcgaacgccttgatgttgatgcgcagcttgccgggcacgtcgaccagatcgtatgcgatgcccattctggaaagatcgcgcgtcagcgtgtcgtcgccgctgtaattgaagccgacacagagcgtttcacgcccgagctggtgcagcgcgatgctgacattgatacccttgccggagatatcgctgcgcacgtttgtgatcttgtttgtgccgccgtatcgaaagccattgatcgtgattgtccggtcaacgcacggattcagtgttaaggtcgttaccatgcttaccctccgattaacccttgagatgatcctgcgcccaatccgccatcgactggtaaatcagccagacggaggtcgcaccggcgtcctgcaaaccaatcgcggcctcgccgtaggattttgcgcgtccaaaccgtgcaacgcactgctttgtatactccataccgcctttggcggcggccgccgcgtcagccaggccgtcctttaaatccttaccggcgtccgccgcctgctccaaggccacaacagccggttcaaatgcgtcgaccatcgttttgtcgccgatcttcgccttgccgcgccgcttgagcgcgtcgagcgaggcgcggaaaatctcggcgaagccgcgaaggtcgattgtgggcgacggcgcgcgcttgacaatgccgctgataaacatggtgccgaacagcacgccggacgcgccgcccatcgtatcaagcaggatattgccgacctcgcaaaaggcgtcctcggcgttttcaagctttgcgccgggcaggtccttaagcacatttttaaagccggttgccatcccgatgccgtggtcgccgtcgccgatcttgatgtcgatttcagtgaggaaatcctcgctgtcaaccagcctgcgcgcgacgaacaggaacatgtcgcgcaattgctgagcattcattgtaagcattgcagtcagcctccgatcgcttctttcttgaaaaacggcgagtaagcgggcatatcataatactttttcagctcgtcatccagccgcatgatcgagatggaaaggccgccggtaccctgtggacggaacagctcgtcgatgaagatgtcgtgcacgcgcgcatttttctccgcgagcagcgaacgaacgcgccgccccagaatacacagctccagagggcttgtgaagccaaacccgttgatcatgacggcgatttcgtcccgttcggtcagcttcatgtcgtcgcagagatatttcatcatcgtctcagcaatttcgtcggcactggtcagctttgtgtgcagcacgcccggttcgccgttgaaacccatgccgtactcgatttcaccctccggcatttcaaacatggcgcgcccgctgcccggcatataacccggcgacgtggtgacgctgaaggtgtacgtttcctgcttggcctttgtcgcgatgcgcacgacctcgtcgagcgaaagcccggcgtcgcacgccgcgccggccaccttgatcacaagcgcgatgcccgccacgccgcggcgttcatccttgcgctcgattggctccgaggtgatatcgtcggtgacaaagacgcatttagcggtgatgccctcaagctcggccagctcgctgacaagctcaaagttaagcacgtcgcccgcgtggtttgtgcagatatagacgacgccccggtcgtgcgggacggcctttgtaacgttgaggatcgtgcgcgagggcggcgcggtgtaaacgttgcccagcgaagcgcccgtagcaagcccgcggcctacatagcccatgatccacggctcgttgccggcgcctccgccaacgacgatggaaaccttgtcgccgtggtcatgtaccataagcccgtttgtgttgggggcgtcgaccttgtcgaacagccccggatagatggagaggtaaccctccagcatctccttgatcatattgtcaggatgattgataatcttgttcaaaccgccttctccttttcccgcgccttggattcgtcctgcgcgatcacaagatgaacgttggcgtccagaatttcctttgcaagcgcccgcgggatacgccagtccgtgataatcgacgaaaaccggtcgagcgggcagatgcgcgccattgtaaccttgccgaatttggtggcgtcgcagacgaggatcgcctgacgcgaaacctcaatgaccttgcgtttgatctgcgcctcggtaagattgggcgttgtgacgcccatttccagacacaggctgttcgtacccatgaacaccttgtcgaaacacatgccttcgacagcccgctcggccagcggaccgacgcatgacataatcttgtgccggacgtttccgccgataaacacgagattgatatcgtaggaatcgatcaattccgtaacaatattgagcgcattcgtaacgacaacaatatttcgcttgtttccgtttctgatcagcttgacgatttcaagcgtcgtggagccggcgtcaagatagatggtgtcggcgtcgtcgatcagattgtaagccagccgcgcaatcgcctttttttcacggatattctgccgttccttttcgcgctcgccgctttcgcgcagggcgacggaaaggctcacagcgccgccgcgtgtccgccgcaggcagccctgcttatccaggtcgttgagcatcttgcgcacggtgacttccgaaaccgcgagcttgccgctcagctccgttacagagacggaggattgctcgtcgagcattttgagtatcatgtttttgcgttccacagtcatcattttcagcaacgcctttcgatttcggtttcattgtatatttgaaagcttcgattttcaagagattttttacaaaaaggatacagtcgatgacaattttatagcattgtccaaattaaatacattaaatttagttataatgtctatatatttggaaataattgtttcaaaaagtttcgaaatgggatacatctggaaaggaaacctgcacaatgttgggtatggattttgaaagcttttgcagggctgtccctccggcacgattttgtgctatactataaacagatgccgtcggccggccggagcgggcgacggcgagctttcactttggagggatccatatgcgacatttggagctgtttttcgactatgcctgcccgtattgcctgcgggcgcatgaactgcttttggagctgctgccgctgcattcagatattgaaattgactggcggccgtgtgaatcgcatccgcgccccgattcctacggcccgcacagcgacctttgcatccgcgggatgtatttcgcgcgcgcgcatggcgccgatcttttggaatatcaccggctgatgtaccgcgcagctctgattgaacgcgcggatatcgaggaccccgctgttgtcgcccgtgcggcggccccgctgcttgatgccggcgcgctggaacaggcactgcgcggcggacggtacgagcgtgaattgcagaaagcgaacgcctatgcctttgaccgttcgggcgtctgggcggtgccggcctatcggatggacgggcgcagactcgacgcgcgcgaaaatatcggcgtgacgcgcggcgagctggcggcttttctggcgggatgagcgcggcggacaaaaagcggctggccgtcgggattctcgcgcatgtcgatgcgggcaaaacaacgctgtcggaggcgctgctttaccgaagcggtgcgctgcggacgcttggccgggtggaccatggggatgcatacctcgacaccgatgcgatcgagcgggagcgcggcatcacaatcttttcaaagcaggcggtcctgacgcttgacgggacagagctgacgctgctcgacacaccgggccatgtcgatttttccagcgaaatggagcgcacgctttccgtgctcgattacgcggtgcttgtgatcagcgggacggacggtgtgcagggccatacgctgaccctctggcgccttttggagcgcagccgtgtgcccgtgttcctgtttatcaataaaatggatcttcccggggcggaccgcgcggcgctgctcgacgagctgcgccgccgtctggacggcggatgcgtcgattttggcgcgccgcacgaaacgctttgcgaggaggcggccatgtgcgacgaatccgtgctggagcagtatcttgaaagcggggcaatttcggacgggacgcttaccgggctgatcggcaagcggcggctgttcccgtgctttttcgggtcggcgctcaggctcggcggtgtggatgaactgctttcggcgctcggccgctatacgcgcgcgccagattatccgccggcgttcggcgcgcgaattttcaaggtgtcgcgcgatcaaagcggcgcgcgtctgacgcacctgaaggtgacgggcggcgtcctgcgcgtcaaggcgcttatgacgaaccgccgcagcgggatgccggatgaacagatttgggaggacaaggccgatcaaatccgcatttattccggcgcaaaatacaagacggccgatgaggttttgcccgggaccgtctgcgccgtgacaggtcttgggaaaagccgaccgggcgaagggcttggatgggaggcggcggcgcagccgccgctgatcgaaccggtgtttgcataccgcgtgcttctgcccgacggctgcgacgcgcacgccgcgctgctcaagctgcgcatgctcgaggaggaggacccgcagcttcgcattgcctggaacgagcgccttcgggaaatttgcatccagttgatgggcgaggtgcagatggagatcttaaagcgccggattctggaacgctttgggcttgacgtgtcctttggaaaaggcggtatcgtttaccgcgagacaatcaaacagccggtacacggcgcagggcactttgagccgctgcgccattacgcggaggtccatctgctgctggagccggccggacgcggcgcggggatcacatatgccagcgcgtgcagcgaggatatgctcgaccgcaattggcagcggctgatcctttcgcagcttgcacagcagacgatacccggcgtgctgacgggcgcgcccattacggacatgcgtatcacactgctggccggccgtgcccatgaaaagcacaccgaagggggcgatttccgccaggccgccctgcgcgcggtgcgtcagggtttgatgcaggcggaaaacgtgctgctcgagccgtggtacagctttcgcctggaggtccccggcacatgcgtcggccgggcgatgtccgatttgcagcgcatgtacgcacgcgtatcggctccggaaacggcggccggcggggcggtgctgaccggggcggcgcccgccgcgtgtatgcgcgattatgccgccgaggtcagcgcctatacaaaggggcgcgggcggctgttctgcacgctgagcggctatgagccgtgccacaaccagggcgaggttgcggcagcggccgggtacgattgtgagcacgacctagattttccggctgattccgtattctgcgcgcacggcgcgggatatacggtcaaatggagcgaggcggccgcgcatatgcatgttgatcccggccgtctgccgggcgtacaagtccatgaaacggacgttcccgcagcgcgcggcacatcgcgggaaacctattccggcacgctggagcaggaccgggagcttgaggcgatctttgagcgcacctacggcccgatccggcgcggtccggccgggccagcgcgcgttgcgcggcagccggagggtgtgtcgccgtgggacggcggggccggtgcggggccggaatacctgttggtggacggatataacatgatctttgcatgggaggatttcaagcggctggcgcgcgatcatctggacgcggcccgccaggcattgatggacctgctctgcaattatcagggctttcgcaaatgcgcggtgattctggtgttcgacgcttacaaggtgccgcgcggcacaggggcggtgagccgttatcacaacatccacgtcgtctacacaaaggaggcggagacagccgacgcctttatcgagaaggtgacgtatgagatcggcgggcgccgccgcgtgcgggtggcgacgtcggacagcgcggagcagttgatcatccttggccacggcgcgctgcgcgtgccggccgacctgttccgaatggagcttgagcgcaccagcggagaaattaccgcttttctggagaaaaacaaccgcctgaaaaagtccctgaacgtcagggcggctctggaacgggcgggcgggagcgccaaagcgccaaaacgggcggccgattcgcccgggaaataaaaagcggagccgccggaaaacttccggcggctccgcttttatgaacgccttcaggcgcttcgatcctgctcgatcagcatgcgcagcgcctcgcaggcgacctcgacagttttgcgcatgtcagtatacgccatgatggacgacgcgcggcagccgcggatggaggagatgacgaaaattgctgcggactccatctccgaggacatgacgttgccgcgccgccaggcctcccaacgctccttcagacggccctcggcgggcatggcttcaggctcgtgctggccatagaaggaatccttggattgggtgatgccctcggcgaagttgtagccgagctttttggcggcccgtgcaagcgcgtcgaccacatgccggtccgcgacggccgggtattcgattgggatgtaatggatggtcgtcccctcgtcgcgcacggcggcggtgttgatgacgccgtcgagcgtttcgtcatacgccttgtcgcagacgcgcccggccgtgcccacacggatgaacgtgtcggcgccgcatttaatcagctcctcaaccgcgatggctgcggacgggcagcccatgccggtggaggtaacggaaaccttgacgccgtttaacgtgccggtccatgttttatgctcgcggttgtgggcgacaagcttggcgtcgtcaaagtagctggcgatcagatcggtgcggaaggggtcgcccggcagcagcacataacggcctacgtcgcccggcttgcagtggatgtggtagagctttccgtctggagttaacatttataatcttcctttcctgccgggacgcctgcttttgcgggcgccctgcggcgtttaaaattgcggcgtggtcagcgcgcgcccttgtcataaggcacgcccgccgcggccggaccgggggagcgcgaggatgtgatggtcaggaccagcaaagtcgcgatatagggcagcattttatagatcgtatccgggatccccaatccaagcaggaacgggatgccggaataggccgcggcaatggttttggtaagcccgaaaaagagcgccgcgaaaaagatgcgtgagggcttccactggccgaaaacaagcaccgtcagtgcgagaaagccgtaaccagcgaccgtggaattgaacatggtggtggacgggatgatgtagataagcccgccaagcccgcctagtgcgccggagagcaaaacgccggtgtaacgcatccggtaaacgtcgatgccgacagagtcggctgcctgcggattttcaccgcaggaacgcaggcgcagcccaaagcgcgtcttatacagcacatatgaggaaataagcaggatcgcgacgccgagatatgtggtgatatacgcgttttggaacagcatggggccgatgaccgggatgtcgcccaaaagcgggattttgtcgatacggaaggtgtttttaaaggacacctgctcaacctcctggacaacgcgcgcgaagaagatgcagaatgcggttgaaaaggtgttgagagccgtgctgctgatggtctggtccgccttcaaattgatcgatgcaaatgcgtgcagcaatgaaagcagcatccccatcgccatggagatgaggatagcggccgcaaggcagagccagaccggcatggacgcctggaacttgcttacaaacaagatcccccaaaatccaccgaacaccatgatgccctccagcgcgatgttcagcacgccgcttcgctcggaaaacagttcgccgagcgcaacgaccatgagcgggacaaagaaaatcatcgtctgctggcagagaaaataaaacgagttcataccttttcccctcccttcgcggcaggcttaccctgcggcgcgctgcgaagctggaaggagcgcaccgcattgcggatgacaagcgcaaaggcgctgaagtagatgatgaccgagatgatgatattgacaatctccggagagaaccggtaggtctgcatatagaagccggacacctgcatataggcgatgaacacagcggtaaagatgatgccgaccggatggttggaggcgagcagcgcaacggggatgccgttgaagccttcggcggcaagcacgtcgacgggcttgatgtatttaccggcggacgacagatacatcaacgcgccgccaagcccgatgagcgcaccggaaatcatcattgaaaggacgatgttgcgcttttcattgataccggcatagcggctggcgtcgcggtttttgccgcatgccttcagctcgaagccaaaggttgtcttattgagcacgatatacacaatcaccgccatgacggccgcgatcaaaaagccgatattggccatgctgccagggaacagtttgtccatgccggcatatggcagcgtgtgcccggctggaacgacctgcgactgacccttgagcgggtcgtagatggcctgcttgacaatatggtttgccaggtacatgccgatgtagttcatcataatggtggcgatgacgatgttgacgcccagatgcgcccgcagcaggccgggcagcagcgcccagagcgcgccgccaagcatacccgcgaaaagaggaatgatccagccaagaggtccgggaaggtcgaaacggatcgcaacaaagagtgaacagaccgcgccgataataaactgtccgggtccgccgatgttaaaaaggcttgtctggaacgcaaggccgacgccaagacccgtcataatgatgggcgtcgcgtagtacaggacgttgcccaaccccttcataccgccggtgaagccgccgagcatcagtgttttaatgccgttggctgcctgcggcggattgcacagcgccagcacgaggaaaccgagcagcaggccgatgacgattgcgaccagggaggccagcagcccggtataattgcgcctgggcacagggccgtgtaatcttttcattgctgcggcacactcctttttgaaccggacatatacagcccgatgtcgttgaccgtcgtttcgccgggcagcacgtccgctacgatctccccttcatacagcacaagaatgcggtcgctgagattcatgacctcgtcaagctcaaacgagataagaaggatggatttgcccgcgtcgcgctgcgccagcagctgcttatggatatattcgatcgcgcccacgtccaggccgcgcgtcggctggacagcgataatcaaatcctgattcatatcaatttcccgcgcaatgatcgctttttgctgattgccgcccgacatgctgcgcatatgcgtcagaggcccttcgccgcagcggatgtcaaaccgcttgatcagctcgcgcgcgtactggctgcggcggtcgaaacggataaagccgcagtgctgaaattcgggggtaaagtatttttttaaggccaggttttcctccagcgtgtcgtcaaggatcaggccgtgcttgtggcgatcctccgggatgaaggagaagccgccggtgttgcgcgcgcggatggaggcgtgcgtcatgtcgcgcccgtccagaacgatctgcccgccgtcggccgggatcagcccggagaggcaggctgccagctcgctttggccgtttccctcgatgcccgcgatgcagaggatttcgccgcggcgcaggtcgaacgaaatatggttgaggacattcctgtttctgttttcacggttggcgacgcacagatcacgcacgcacagcgtcgtctcgccagggtgaaattcctgctttgcaaggcgcagctcgaccttacgcccaaccatcatctccgacatctgttccggcgatacgtcggctgtttcaacggtgccgatatacttgccgcggcgcaaaaccgtgcagcggtctgcgacttgcttgatctcgttgagcttgtgcgtgatgaaaatgatcgccttgccctcgtttttcaggctgttcataatttccatcagctcgtcgatctcctgcggcgttaaaacggctgtcggctcatcgaagatcaggatattattttcgcggtaaagcatcttgaggatttcaacgcgctgctgcataccgacagaaatgtcggacacattggcgtccagatcgaccttcatgttataccgctcgctcagagaaaggaccttggcgcgcgcttcgtccatcctgagacgcccgcccctgacggtttcggccccaaggatgatgttctcaagcacagtgaagtttttgaccagcataaagtgctggtgtaccatcccgatacccagatcgttggcggtgtgcgggttctggatcttgacgggcttgccgtcgagaaaaagctcccccttgtccggctggtacaggccgaacaggatgctcaccaaggttgatttgccggcgccgttttcccccaaaagcgcgtgaatttctccacggcggacctgaaggacaatgtcgtcgtttgcgacaacgcccggaaacagcttggtgatatgcatcatttctattgcatattcgctcatatgtttcaccctgcgattcttgtcggtggtatgggcggccgcaaaatcagcccgaaactgattttgcggcgcgcggcggatgcatgagacacggcggtcagttgatcacctcaacgttgacaagcgacagtccggagacgagcgtttcaagatcgatggagtttccgctttcatcgacatccttaaccatcccggagacgacgccgtcctcgtcggcggccatctttgcggcgatcgcatcgtaatcggcctgcgtgaagtttttaaagcgggaggtttccatcggcaggccgaccgcgttgtccttgatatcgaggcgcgcgttgacgccgcccggaaattcgccgttatagaacatagtgatgccgtcgtaaaccgcgacggagaggtttttcatcgcggaagtgaggaccgtttcagagcttgccgactggtccagatcgacgccgatcgcgacacaatcgccgccgactgattcacacgccgcaaaaacattgtcgggcgtgccgcaaccgaagatgcactgcgtgccgctttgataccaggaggccgccttcgtctggttttccggcagaatatcgaatgtgccggtgtaatggtacttgcaggagacggctccaggctcaagcccaagctccctggcggcatattcggcgccctggagatagccgtagccatagcgcacgacagacgggaccgccatcgctccgaaaaatccgagatcgcggtagccgtccttcacagcggcgtagccggcaagaaatccggcctgttcttcagcgaaaacgatcgagtatgtgttgtctgccgtcttgtagtcggtataggtgccgtcctgcggcgtgccgtcaaggatgatgaatgaaacgtcgggatacatgtcctgcgccttgtacacagcggcttcaaacagatagcctgggcatacgacgagcttggcgccgttattgaccgccgattcgatagcgaccagatagccgtccgtggattggtcgatgggacggtaatactgatgcgtgatgttgttttcctcggcgtattttgccagcccttcccatgcgccctggttaaagccgcggtcgtcgatggagttggcgtcggtgacaacggccagctcgtagacagcgccgccgctggaaccggcgggcgtggaagccgcgcccgatgccgtgctgccgccggatgaagtgccgcaggccgccagtgagagcatggcgctggctgcaaggaatgcgcagaggatacttttcaagctttttttcatttcgaaacctccaaagatgattcttaagtttatgggtgcgggaggaccgcacacagtttccagaattttggaatcgcattcccacgtgggaatagcgggaaaaggccgccatggcggccttttcccgcattcccacgtgggaatagcgggaaaaggccgccatggcggccttttaatccttctatagggacaagaagggcgcttggatatcaaaaatcagcggagcagcttgactgcggagcttgtaccaatgcggtcgcagcccgcgtttacaaatgcttcaagatcctcgggcgtgcgaatgccgccggcagccttgattttgaccttcgggcctatgtgcttgcggaataaagcgatgtcctcaagctgcgctcccgcggtgccgaagccggtcgaggttttgatgtaatcggcgcccgcgtccgtaacacagcggcacagggcgattttctccgcctcggtgagataacaggtttcaatgatgaccttcaggatgcggctgcccgcagcctgtttgaccgcgcggatttcttctgtgaccttgtcgaacgcgccgcttttaacgtcgccgagattgacgaccatgtccacttcaacagcgccgtcagcaatggcctggcgcgtctccgcaaccttgatttcggttgtgttgtacccgagcgggaatccgatgaccgtacaaatggcaagcgcatcgccgtattgatcatgaatgcgcttgataaagcacgggggcacgcagacagaagcggtgtggtatttgaccgcctcatcgcagagcaactcgatttcaggccaggtggaaacagccttgagcagggtgtggtcgatcattcccaaaactttttctttgtccataaaaccctccgttaatctgacagtgaatcgattttgtgataaaataaatgcaatgcatttattctatcttttatggccagggcgatacgcgggcgcggcccgctgccgccctgatggccgattttatcatgctgctttgtgagcatgataaaatactaacatttcacaaatgttgtgtcaatctattacgaggtaatttctctagtttagacataattaatattttggatttattaattatgcgcatatactgttgcacaaacaaaattaaaaaatactttttatcaaaaatatcttttgctttttgataaaaagtgttaatatgtgattggaattttgataacagcaggatacagggtgtttgaatggaggctaatagcgtgggcaagaaaaacgatagactcaaccggctcattgggattttaaaaattcgcggcgcggtatcgatcagggagcttgcgcagacgctggaagtctcagaaatgacgatacgcagggatatgaagctgcttcagcagaataaggtggtcgaaaatgtcgatggcgtaatggtctacaatcccgcgcatacgcttgtcgaaacggacaaggagtacagccttgcgttggaggaggaacgcaggaatgcggaaaaagctgcgatcggtgcatttgcggcttcgctggtggcgcaggacgatatgattatcattgacacggggacgacaacggtccacatcgcgcgcaatttgccaaccaatttgcatctgtcggtattgtgttataatatcaacattttgatggaattgagacgaaaaccgaatatacaaccgctttttgcgggcggttattatcacgcaaatgcacagatgtttgaaagtaaggagggcgttgaattcatcagcggtatccgtgtgcaaaaggcgtttgtttcagcggcaggcgttcactgccagttgggcgtaacctgcatcaacaattacgagatcgagacaaaacgggcgattttgcgctcctcgctggaaaaaattcttgtagcggattcaagcaaatttggccgggtctgcgcggcttactgctgcgatatgaatgatattgatacgatcatcacaaataaggacctttcgcccgaatggatcgaccagattcgcagcaaggggatcaagctgtaccttgtttaattatgagcatgcgccgcggctgatacagcttttgatttttaaaaaagccccggatacagacgaaaaatttgtgtgaagaatctgtgttcctattggacagcgcatagggtttggagtataatagaagcaatcacacctatgggaggttttggcatggcggataagaagcagtttgacggatcggaaacgtcgaaaaagtctaaaagcctgcttttctctctctcgcaggcaaagccggcgtccaccgccgaggcggagacatcggctaatcaaagcttgctgtacacgctctggaaaagcgtctccggaaagtttgcgaagcctgcacagccgcaggaagaaaaaccggctgcccaggagccggaggcggagctgtttgaggatgatcatccgcttgcaaggctgcggcgcgcctggagccaggagcaggcggcatcccgtggggacaatacagattcggaccaggcgcccttcgggccgcgggatctgcttgatggcggggagctgctgccggttcaccgccggctgatcgagcaggctgcccggtcggctgcagagatgctcgcgtcgtttcatggcgatggtgaacagctccaggcggtcaatgggcatgtcggggtgatggaatccgaggatggcctgagcgcctggctgctgttgctgccgccgctgtatgggggcggcgatgtgacgctggagcatttgtataccgcgctggtcgagcgcggtattacatatggcgtcgacatacaggcgcttgagacattggcgcagcctctttatttccgtattgtcgaggctgcgcgggggacgccgccggttgacggtgaggatggaagcgtcgaggaggtcatcccgaccagttccagcgtccggtttgtggaaaagcaaaacggcatcatcgactttaaagatatgaactggttccacaatgtcaatgcgggagacgttctttgccggctgatcccgcctgtgccggcaaagaacgggaccaacatccatggcgcccagcttaccgccagggaagggcgcagggctgtgccgcctgcggggaaaaacacggttgtcagcgaggacggccttacgctcgtcgccaggattgagggcgaggttgtttaccggtcgggccaataccatgtggagcaggcgcttacaatcaatggaaatgtcgatttttccacaggcaacctcgatgtaaagggcgcggtgatcgtgatgggcgatatctgcgaaggctttacagtcaaggccagcggcgatatcactgtatatgggatgatcgaaggcgcgacgctggtttcgggcgggaacatctttgcaaaaaccggcatgaatggaaatggaaagggttcaatgacagccaggggggagatccgctgtaaatttattgaaaacggttctgctgatgcagagggaaatatttatttggagagcgcgatcaatgcgcggttgtcaagtcaaagctccgttttggtcaaatcaggccgcggcgcactgatcggcggggaaactgtcgcgatgaaaacgatcgaggccacgtcggccggcaataaaaacaattacctgacaaccgtttccatcaaagcgaccgaatcgttcaaaataaagcaaaagcaggtcgaggacgaccttcggaaaacgtttgaggagctggatgagctgacctcgtcagaaaacggcacggctatgacgaatgaagcgcgcctgcgcagcagcacgttgaaaatgaaggaacgaaagcttcgccaacagctcgagcagatgcgcgcgcaatgtgaggagctggattcagccgtcatgcgcttcggcgcactgtatccaaacacggtggctggaatcggcggcgcggccgcaacctccaagcaggagcatactcactgcctgatttatcaaaaggatcgtgaaattgtgtttggcacggtataattgatattttaattttcaaacaggccccagggaacaacatgattttaggtgaagcaaagtggatgatttggatatcggcagcgtgctgcaggccagccgcggtgaaaaaaagatcagcctgcgccagttggcggaaaggactggtctgacagcttcgatgttaagccagattgaacggaatcttgtcaacccttccatcaatacgctcaaggtgatcgcagcggctctcgagattcccatgtataaattttttatgggcggcggcgctgacaaaaatctggtcgtacggcgtgacgcgcgcattacgctcggacgtcctgaggcggaggatatcgtatatgagttgctgaccgcgaatgtcagcggcagtatcgaattctgcatgatgcacataccggccaagaacggttcccacaatgtggagtccatccacaagggcgaggaagtcgcatatgtggcgcaggggaagattacagtctatatcaacggcgccgcatatgaactggagacgggcgacagcgtgctgattccgccgggcagcgtccaccgctggcagaacagcgcggatgaggaggcgcaggtgctgtttgccgtcacaccgccgagtttttaactgtgttcagttaaatttaacaaatttcgaggctttctgttcagcattcatacagatttctctctgtatagccaattttttaatggaatctgttgacttccaataaaatgatgttaaactgtacttaacgatacggctttattgtcgtgtacagtttaacatctttctttttttctaaggaaaataacggtattgggaggtcgtttttatgggaaaagatttatcggcggcgtatgcgtacattgatgaaatccgggatgaaaccattgcgctttacaaagaatttgtaaaccgtgagagctggagcaaaacgccggacaaggtccgtattttttccgattttctcaagggggagatggagaaggccggctttgaatgccgctatgtgcctgtcggcgtcaacgccgatacgcttgtcggcattctcggcaaggaccgtcctggtaaaccgattctgttctgcggacatatggacacggtgttcccgacagggatgcatccggaaaacccgtttaagattgaggacggaaaagcgtatggaccgggtgtgctcgatatgaagggcggcattctgattgcgctgacgacagtcaaggcgctgaacaaaatcggatatgcggacaggccgatcaagttctgcttttcaggcgatgaggagatcaatcacaccggctcgcagggcgctgaggtgatcgaggccgaggccaaaggctgcctgtgcgccttcaatatggaaaccggcatgatcgacaactacctgtgcaccgggcgcaagggctgcctgcgttacacggtggaggtcgacggtgtggagacgcactccggcaacgacttccagggcggcagaagcgccattgccgagatggcctataaaatcattgattttcacaatatgaccgatctttcaatcggaaatacctgcaacatcggcactataaccggcggaacggtacccaacgcggtgcccgctcactgtgaagtggttctcgatatgcgctataccactctgagcggcaaggagaaattgctcgcgcagcttgatgaaatctgcaagcgcacgcacatcgacggaaccaccacaaaatatgcgtttttaaacaagctcgatgtgtttgagacaaccgacgaagggatgcgctttttcaattttgtaaaggacatcgcaaaggaatacggcctgcctgaggtcagcgggcgtccgcttggcggcggttccgacgcggcctccacaaccatggccggtgtcccgaccatctgctcctgcggcgtgcgcggtcagtggaaccataccatgaaggaatatgcggttgtcgattcgattttcgacaggagcaaaatgtatgtcgccgccgttgcaaatgcagaccggtttgcagagggtgcggactgagacggcgaaacgatcataaaaattcctgcttaggagggagagatagcaatgaataccctggttgtgtttctgatttccatgatctttctgttgacagttctgatcaaattcaaatggagcgcgtcggtggggcttgtgttggcgaccattctgatgggcctgctttcaggcatgcaggtgggcgagctgaccggctttatcagcggcgggtttggcaataccatgacaagcacgggccttgtcatcatcttcggctgcatcttcggcgagatgctcggttcctccggcgcgctggaggaaatcgcgaaattcctgctgcgcaaggttggctccaagcatgattacctcgcgatcaatctgctgggctacgtggtgtccatccccgtttatttcgggtcggcctacgtcatgctttcgccgcttctgaattcccttcagaagcttaccaacaaaaaaatgattgggtatgtcaacgcgctgtttgtcggcttgctgctgacgcattgtgttgtagcgcccacgccgggtccggtcgctgtcgcggcggaggttggcgcaaatctgggctggtttatcttctacggtatgattgtctccattattgccagcctgatctgcggctggcagttctccaacgcactcaacgcgcatgaccggaaagctgtgcgggagatgatatcctcggacaacgagctgattcaggctgacccgacgaagccgtctgcggcgacagggttccttctcatcctgtttccgatcgttctgatcgtgctcggctctgtcattccgatgtttgttgcagaaggttccgtcatctatacgattttccagttcgtcggcgataagaacatcgcgctgttcatggcgatgctgctttcggcaatcgtgctcagaaaatatcttgttgcgggaccggcgagcaaggggatcatgcgctacatcgattccagcgccaacaaggtcggcagtatcctcatggtcatcggatgcggcggctgttttgccaaggttatcacggaaacgggtatcggcgacgcgctggcggagatgttctcacactttaatatgccggtgattttgcttggttttattcttgccatgattatccgcgcggcagttggttccgcgaccgtcgccatgatgacggccgtatcgattgtcggcccggccatcgcaattcaggggctttccccggtgcttgtgggtcttgcggtctgcgcgggtacggtcggcctgacgcttccgacggacggcgcgttctggcatccgtcccagctcaatgggatttccatcaatgagacgatgacagtcaccatcagcacgactctggccagcttggcagcgtttgcaatcattctgctgctcaactgcttcagcggcgttctgcccggattattttagaaattaggtgccaatccatggaaaacatgatactgacaatgacggaggatgagtgggtaaaaaaatacccgctcatccgttctctccagaatttgcaggaatgcttctggatcaacgacaaaaaggaaccgtttgacagcgcggtcaaaaaatgcgcgcttggtatgcatgatattgaggatgccagcgaccggctgacgcggtttgcgccgtatatcgcaaaggcgtttgcacagacggcagcaagcggcgggattttagagtcgccgctgcgcgaaataccgcatatgaagcgcgcgctggaggagcgcagcggcgtcgctatcggcggccggatgctgctgaaatgcgacagcgagctgccgatctcaggctccattaaagcgcgcggcggtatctatgaggttttaaagcacgcagaggaacttgcagtcgaacacaagctgctgtcctatacggatgattatgcctgtttggcgcagccgcgttttcgggactttttttcgcagtataaaatcgcggtcggttcaacgggcaacctgggcctttccatcgggattatgagcgccaagcttgggtttcacgtgacagtccatatgtcggccgacgcgcgccagtggaaaaaggatatgctgcgcggccttggcgtccatgtcatcgagtatgaaaacgattacagcaaggcggttgccgagggccgccgccaggccgaggccgatccgtactgttattttatcgatgatgagaattccaaggacctgtttttgggctatacggtggctgccctgcggctgaaaaagcagttggaacagatgcagattacagttgaccaagcgcatccgctgtttgtttatctcccgtgcggcgtgggcggcgggcctggcggtgttgcattcggcatcaagagcatctatggggatgcggcgcattgcttttttgcagaaccgacgcattccccctgtatgctgcttggaatgtatacgggatattatgaccgcgtcagcgttcaggatttcggcatcgacaaccgcaccgcggccgacggcctggcggtcggccggtgctcgcatctggtcggcccgatgatgcatccgttcatgagcggtgcgatgagcgtctgcgacgagcgcatgtaccggctgctggcgatgatggccgacacagagcaaatccgcctggagccaagcgcgctggccggcgtgccaggcgccgtcaatttgtttggaacgaatgcgggaatggattatttaaagcgggaggggctttccgcgtccgctgaccatttcacgcacattgtatgggcaacaggcggcagcatggtgcctgacgacgttatgcgcgcgtattatgaaaagggaaaggcgctgcaatcgctctgacaggcgctttacaaaaaagcgggcggggcgggctgtatttacagcccgccccgcccgttccacctggtggacatcaggggtgggatacccaccggcggtaccggcaggcggtcgggcgcggggcggcacccatagaggcatgaaaaagttgacagagcagataacgtaccctatactgaagaaaaggctttttgacctggctgaaggggagggcgccggcatgaaaagaaccagagacaaacggccgcgcggtatggaccgcatttggagaggagccatctacgcggcgggcatgatatccctggcaatcgggctgaccttgtataccaagacagggcttggcgtttccccggttgtttcggtttcattttccattacggaaatttggggaatcaattacgcgctgtcaacctttggcgtctacatgctgtttttggcggttcaattgcttctgaagggaaaggcgcgccgcccgggtgatctgctgcaaatcccattcagtctggtattcggcttgctgcttgactggttcagtctggtacaaatccgtttttacacactgtggcaaaatctgctgctgctttttgctgcgatggcgtttacagcggtggggatgtccatgatggtcgacatgcgcctggtgttaagtccggcggacggcctggccgacacgattggaacatgtacaggcagaggcgtcggctttggaaaaaatattgtggatctgtcctgcgtggttgttacctgtgccgtcagttatcttttcagcggcaggataacagcgattggacttggcacactgatcgcaatgatctgcgtgggcaggctggccgcattgtttcaactgttgttttacgagccgctgctccggcgcgcgggtttgccggaagcacaccgttgcggcgcctcggaacaattggcagaggaatccgcctgatcagaccgtcggcggcaagggctgcgttcaggttggtggcgtatgcggcaagcagccggataccgctaatttgcaggatgaatttgtgatagagctgaatttatacccatcatggatgaacgggagcatctttttttgatgctcccgttcgtccatgtgcggccgtgcatccaatttgacggatacggcgcttattcctgggcatttgatataattttttttgccagatcataaatgctttgcttgtaaatgacgagacttatttccaggctgggatgcgacttttcaaaaccagcgattacatccgctgcaatttgaagcgcctgggcgcgcggaatatgaaaatcgccggaaaacatcagtggaatcgcgacacttttgcaatggtaagcggccactttttgcagcgcagagcggtaacagtcggcgaacagcattctgtcgttatagcggccgctgtaccacccaatgcccgccacatgaataatatatttgcaggcgagtccaaacgacggcgttatgacggcttttccgatgcggcatcgccctatttttttacaagcggccaaaagcttttcagtatccgccgcggcaaaaatggcgctgcaaataccgggacacggcctcaggtcggagcttgccgcgttgacgatggcgtctgtgtccatctttgtgatatctccaagtaccaaacgcatacgatcactcctgtcacataacaactccgccaatgagataacccgccgcgctgacagccgcagcaagcagcgcatagggcatctgcgacagcgcgtggtccatattctgcattttgcagcagcttgaggtcaataccgtcgcatccgaatagaagcaggcatgactgccgagcactgcgccggaaacgatcgctcccatggtcagcagcggatttgccccgattgaaaaggcgagcggcaggatgatgggcgtgacaattgcggggatgccccaaacgcttccggtgctgaaattcaaaattgcgacaagcagaaaggtaatcatgggaaatacagcggcgttcacaaagggacggacagcattgattatgtagcctgcgattccgatatcgctcatcgcttcctgcattacgaaggcgaaatagatgattgcaatggtggggatcatattgcagaatccatgcatggccaggtcgcaaaatcgggtgagcgtcaattttttgcggggaacatagagcgcaaggcaggtcaggattgcggcggctacggcaagaaacagctcgcccgaccagatggccagcacaatcaatacgccgaccggaagaatgaaatctatgatatttcccttgacctcaactgcgcgcgcatcctcatcttcctcctccaggttcaattccctgctttccagggaatagacctttcccgtcgttttaacacggtcatatgcctttttcatacggcccagcttgggcagaaagccaaagcaaaacaacggcacgattacaacggcggcgatggcatagaatgtgtagggaatgacatggtaaaaggtttcaatcgcgtttccatagccaagctccgcgacgccgttctccgcaaaaaagagtccggagaaaaagatcgcccaggtggaaaaggggagcagcgcgcagaccggcgcgccggtggaatcgatcacataggagagcgtctcacggggcaccttgtgcgtatcggtcagctttttcatacaggtgctcaaggtcatgatattcaagtaatcatccacaaaaatcagaatccccatgatccaggtgaccagaagcgtggacttgggtccgcggcacagccgtccaagccacttggaaaagccaagcgtcccgtgggacgcgcccaaaagcgcaatcagactgccgaacagcgcgcagaccatgaacacccattcatgatcgcggtctgtcgccaccttgaaaaacgcctccatccacccggtggggaaattccatccgcagatgatgatgtaggcgacaaccgtgccgacgatcaggggctccaaagtccgtttggtcagcaatgccaaaacaatcactacgataattggcagcagggtccaaaggccaaaatccattttagtccgcctcgatttcttatatgtttttggggacatgattaaaaaccagcctgtgcagaaattgaaaacaagcgcccgtacaaatcggttctgagcaagccctttgaaagacggcgacgtaaaaaccgcttgcaatcccaacgctgctatttcgctttctattacggactaatatagcagattctattttaaggtgctgttaaggtgcgttccctcctgttaaaaaagcattatgatctttggctgtattagaagctgtaccaatggaggaacgcacatgtcccggcggaaaattttccgtccgggctgcgtcagaaaaacttgaaatccgccaggattcctacgcgtttcttccttgccgggcaaaaaatttcctcaccgctccatgcactttccccattggtacagcttctaaatcaaaaccggccgccccaattgatggggcggcccgccgatatgaggcgcttattccacacgcagcatccggtatccgacgccgatatgcgtttgaatatactgcggggagtcaggctccttttccaattttttgcgcagtgtagccataaacacgcgcagagaagcaatatcgttatcccagcttcgattccagatttgctgggcaataaacgtgtgcgttaagaccttgccaacatttttagataacagacataaaagcttgtattcgctgggggtcagatgcagctcctgaccgtccatataggcgcagcccgcggcataatccaccttcagctttccatttgtgaatacagaatccgcgtttgccataccgcctgcctgtatcgcagccaggcgccgctgcgtgacgcgcagcctggcaagtagctcctcaacggagaacggtttggtcaaatagtcgtcagcgcccgcgtccaaagcttctattttatcggtgtcctcgctgcgggcgctgatcacgataattggaagattggaccaggttcggaccttgcgtataacctcgatgccgtccatatcaggcagccccaagtccagcaggatgatttcgggattgtgtgaggacgcctccaaaatggcggattcgccgttggcggccgtcaaaaagcggtaatcgtgcgctttgagcgtggttgtgattaaattacggacgggtacgtcgtcctcaacaactaaaattaaaggtttattcatgcagttcaacctccccggatggtattgaaaatgtaaagattgtcccatgcggaatttggtccgcaacgctgatttctcctccatgcgcatttacaatcgatttacacagcgccagccccagccccatgctgcggcggctgtccgcgattttggcggaggcgctgtaaaacatttcgaatatatgcggctttgcttcagcggaaatgccgggaccattgtccgcgatggaaacaaggacaaaatccccctgctttttccactcgatacggatatcggaacctaccggcgtatattttatcgcgttatcgatgatattgatgagtacctggacgataagcctcacatcgatttgaaccaaaatgtattcatcaggttcgcggacgatcagatggtagtccgcgcttttgcggttgatatggcgcagcgcctctgcaattacttcatccatgagttctgtggacatatgcaagttcatacgcccttcttccagcctgctgacggacaaaagattttccaccagattgatcagccacatcgcgtcatcgtatatgtccgtatacatttgttctttggtctgtgcgtcaaacagcttgccattggaaagaagattgcttgcattccccgatatggcggtgaggggtgtacgcagatcgtgggagatggagcgcagcagattggcccgcagctgttcgttcttggccaaaacagcagcggcttccttttcctgcgcgttcttctggttttccagcgccaaagcacactcccccaaaacggagagcaaaatgccgttttcaaaagaatccaacggctttgcttttgccgctattccaatcacgccatatacccgatcgccgattcgtacagaccaatagacgcagagggaatcagaaaaggtttcagtcccagtaccggcgcgccggttatttttcataacccactgtgcgaccgcttgttcctttgcgctggtatacggcgtatcagaacagccctcctcggcggcacaaaaaaggatcggttgtgacaaaacgccgttttcagcgcggtatacaacgatatccctttgaaaaagtctgaccagctgccgtgcggttatggccatgatttccgattgatccatagccttttgcaaactctgattcgtttcaaacaagagtttcgtgcgccaggcaacctgtgcggctctctgtgcgtgggacttcagctttgtcgctaaggagccggtgatgagcgccgcgataaacatgaccagaaatgtgaccagatagccgctgtcatatgcatgcagagaatatcgtggttctgtaaagaaaaagttgaaaataagaacgctggcggccgatgaaataaaactgcatacagggcttttggtggcgacggagatcagcatgacgctgaggatataaatggtaatgatattggcttcagtaaagccaagcttgaaaaacagaaagccgacaagggttgccagaagcaacagcagcacgctttttacaagatcacacagggaaacggataaaagccgcgttggttccctgtaagcaggcgcagtgcgcttgttgagtccattgtcgggaatgatatgaatatccagctctggagcaagctcgatcagccgttctgtcaacgaaggcgcgcggaaaatggttcggcgggatatcccgctgcgcccgatcatgatctttgtcacaccggataaacgtgcaaattccgcgatctgatagggaatatcgtcgccatatacagtttcgatggacgcgcctaattgttcggccagacgaatattggaccgcagtctgtctttgtcggcctgaaagccccactggaactgtttcgtttccacaaacaacgctgtaaagctgcatcgaaaggcgccggccatccgtgcggcggtacgtatgatcttggcgttagagggtgcagaggacagacagacgagaatgtgttcatgggtccggtatcctgcttgcttctgtgctttgcgagtttgcagcgcaatccggtccgcacagcggcgcagacctaattctcgaagggcgttcaactgtgtaacggataagggggaagataaagcgccgggctgcttcgatttcagacggtcgagcagatcctgcggctccagatccgcaaattcaacccggtcggcagcgtcaaacacactatcgggcacccgttcaggcagaccatgcccaatgatggctgagacggtgtcctgaaggctttcgatatgttgaatatccaatgtggtatagacatcgattcctgcctttaaaagctcctcgatatcctgatatcgttttttatgccggcagccgtccgggttctgatgagataaatcgtcgatcagaatcaattgcggcattctgtgcagcgcggcgtccaaatcaatttccatagatgcaggcgttccctgctgaatttgcttgcacggcaaagtctcaaaacgatctgccattagctgtgtttgcggccagccgttcgcggcgacaagtccgctgacaaccactgcccccgcctgcctggcgcgctcggcggcctcaagcatggcgtaggtttttcctgatcctggcgcataaccggcaaaaatggtcagggaaccttttgattcagaccgggtcattggagccattgaagttcccccctttaaacaaaagtagaaaggactggggccagagctttagacgtgacgtaagcgcatcatctatccaaaggaatcatcgcccaggccatgaaaggtatcataaccgctttgcggttatgataccatgtccgcgaagcggcgtggtataatcgcccatcaaaaggcggttgctgcgcaagcggcgagccgctgggcataaccctggtataataaccgctttgcggttattataccacagacttcaaaaattccttacacccacacgccgaataaattccgggacaagcggagagggcgtttctttgctccaaaccagagcctgcttgtgcatcatatgatctataggctggagcaggacgccggattcgtcaagacgcagagtccgcggctcaaacttgacgaatgcggtttccagacacaggccggtccgtgtttcagcagaaacgacagccaaatcggcctttccacatgcaagatactcaaggatctcctgttgttggccaaaaacaattgtcacttccaagtttggataatccctttttatatcgttgtatgtatccaatacaaactggatcgcatagaggcttgaaaccgcgatcatcaaatgacagcgttccgttttttctgtgctgctgcgtatccggcccagatcattgtccagcctggacatcagataatagaggaatacggcgacgcttaaaaatccagccaataaaacaatttccatcagcacgcctcctttggcttgcagataaagaatgatttatatatggaagcacttttgaacatcacgcagagttcctaaaacaagaaatgtactgtgctccggcaggcaggtttccggtttgatgacggtcatggagaacttcccgttttccttgatagccagaatgttgacatggtaccgtttgcgcacatctaactgtccgatggtttttccggcccagctatccggtacagatacttcgaaaatagcctgatcgtccccaagtgaaatataatccgagatatgatcggagctgtatcggatagctgtccagaccgccatctgcttttcagggtatacgacttcatccgcgccattgcgcagcaaaaattttgcctgtacatcccgtgcggcccgtgcgaccaccttttttgcccccagttccttcaaaagggacgccgtttccagagagctttgaaaattatccccgatggcaacgatgcatacatcaaaattgcgcacccccagcgaagaaagaaattcttcgtcggtgctgtcgcctatttgcgcgttggtaacaaagggaagcactgcgtttactctgctttcgacccggtcaaccaccatgacctgatgatttaattcgttcaatttttgtgcaatatgacgcccaaaacggccaagcccaatcagtagaatcgctttcataagtcctccttaaaaagacggcgtttccgattttataactgccttctagccaacggtgatccgctcctgaggcagcttcgcatttgttggctgcgtatgtgacatggtggcaaagatcaaggtcaagcctcccacgcgtccaaaaaacatgagagaaatcaaaatcaaatgggatacaacccctagccgtggggtgatattcagagacagcccgaccgttccgatggcggatgctgtttcaaacaggcagtcgagcaggggaaggttttccatacggctgatgatcagcccggctgtcaaaaataaaaacaaatacatgatcaagatggttgcagcctggcgcaccgcatcgttggagattcgccggttaaaaaaattagcggactctttcctgcggaaaacagccaatgagcttgccagcaaaacagccagcgtcgttgttttcataccgcccgcagtagaaccgggtgaacctccgaccagcatcaaaacagtcatgataaattggccgggttcgctcattgcagtcaggtctgcggtgttaaagcccgcggttctgggtgtaaccgactggaaaagagaaagcagcagccgctcgtccaaaggcgcctgcacaaactcaaaaaggaaaaaatagacggaagggattgcgatcaaggcgagggtaacggtgagaataaccttgctctgcatccggtattttcgaaaatggaaacgattcgttcgtatatcatcccatgtgagaaatccaatgccgccggtgatgatcagcagcatgatgacaatggagacaatcggatgatcggaataactggtcaatgacgaaaagggagctatgacccccatgaggtcaaagcctgcattacagaatgcggatatggaatgaaacagtgcgtaccatacgcccctgagcgtcccgaaatccttcaaaaaaatcggcagcagaatcgctgcacccagcagctcaataaccagagcggtctttaaaataaatccggtcagacggacaatcccgccgacatttggcgccgcaatagcctcctgcatggtgctgcgctgcatcagaccaattctgcggccggaaagaatggcgaaagcacccgcgaccgtcaccacgccaagccctcctatttggatgagcagaataatgataagctgcccaaagccggaccaataggtcgctgtatcgtgaaggaccaagcctgttacacaaacggctgaggtggatgtgaacagcgcgtccacaaagggagtccagatgcgctgttttgtggaaatgggaagcatcagcagaaagcttccagccagaattacgagcaggaatcccagaataataatctgaaaaggcgatgtgcgttttttctgctggagcggccgcataaacaccatctcttaatacctctttataaaatctttatacacccattatccacatcgggtctaaaaggggtattaatgttttataatccgcattaaaatggcattaagacgcgcggtgccgtgtattcatcctgccggaattccatgtatttgcaagttatgtattcttatagccatccgcacaacaaggagattggaagcatggcggccagtgtgcagataacaaccgcgagcagggtgagcagaggcagccctataaacattacaagaagtccaagcagcgggtgatgaagaataaaacgttcagcggttgtatcaaaacggttttcaaaacgggaaaacttccttttcagcgtatccataatgggttcctccttatgaacccattataatcaatgcaagcttaaactggggataagattgatggactgaggttaagaattaataaatattcaaaagaacaaggcgtccggcctgtggataccacgggatgaacgccttgctctttattgttttttgtgttgtaaaatggaccgcagaccccaaaagtcactggtttaacgggaacaaaattttcataagcacctgctcggcggcccctgtgtgatccacgccaaaataaagccgcttgcccaaaccatccagcagctcgaattggctgccgcggcagatgaattgtatatttaactgctccaggacgctgaaaagtgaaagcgtccattcgatccagttgggtgcgcactgattgacaagcgtatcccacagccattcaaattccggcgggaaaatccgtttttccaaaaacaggagccacaacttctgcttttgctccagggtcaggctgagcagacaggctaggggagcatcatccgggcagtcttgttcaaaataaacgtagcagaaggacagcgtgcggtcaatacaggccagatgctgctgttcgagaaaatcggcgtactcccattccattgccgctgcggggcgtccgtcctcaaccgcccggagcaagtcaaaaaggcagcgcgctgctttgatgtcaggcagaaggagagtcaggtacaaatcgcgcagctcgtcaaaccaaacgccggaaacgctttgctggcgcatcacaagactgtcgccgtcgccggcaaagctgattccgatcaactcgccgctgtctgcgatgccaaagacctcaagcggccaggtttggtctattttggataccaaggaaccaaaattttcagccagttcatcggttggaaaggacaacacctcatatccaatctttagctgtctgtcgccgtgacggtaaaaaactctgtgaggcagaccgagccagtcgttcagagattttatcaggcagatgatcagccaagcgggagaattttccacagccacggtctttggacaaatggtgcgttctatggtttgattgtagcgaaaccgcatatatgcgcctccgttctggcgattggttcatccccttttattgcttgccggcctcgcggatcagtcccatgctctctgcaatgtccaaattgacgcccagaacgttgacggtttcctcaccgaaaatgccaagcagcttgccctgcgtgttatcagccacaatctgttccagctcctgctggctcaggccggaggcttcagccaaagccggaatctggatttgtgccgcttgtggagagatatgcggatccaacccggagccggaggctgtcaccatatcggcggggatgtcctcgcggctgacgccgggattggcgtccaaaaacgcttcaatatccgcttgtacacgttccacaagggcagggttggagggcgcataattgttggagccggatccaaggccggaaaattccgtaccgtcgttgtaaaactgattgccctgggcatcctcgtagtaggtgttgtaatgatatgctgaaggacgcgttttcataaagtagggctttgtaaattcctgccccacatgggcggcgccgactggcgttccgtccgctgtaaccaggctgccatgcgcctggcttgggaaaattacagcggagatcccactgagcacgaccggaaatgcaaagccgcagagaaagagaagcagcagtgttacgaccacggcctgacgcacccagtggaggaaggcgcttttatttgtggtttcattcataagggatacctcctcagaagcccatccccatcacgcctaaaagcggggtgataaggatatcgatcaatttaatacctacaaatggtgtgattatgccgcccaggccatagatcatcatattgcgcgccagcatttttccagaggacatcgggcggtatttgacgcccttcatcgccagtggaatcaagcacgggatgataatcgcgttgaagatcagggccgacaggattgcgctgtattgtgtggacagccccatgatgttgagcatctgaagctgtgggatagccgtcataaacattgcgggaatgatggcgaaatacttggcgatatcgttggcaatcgaaaacgtggtcagcgacccgcgcgtaataagcagttgcttgccaatctccaccacttccaggattttggtgggatcgctgtccagatcgaccatattggcggcttcctttgcggcggtggtgcccgaattcatagccagccccacattggcctgggccaaagcgggcgcatcattggtgccgtcgcctgtcatagccacaattttgccttcggactgttcttttttaatcacgctgattttatcctccggcttacattcggctatgaagccatccacaccggcttccttggcaatggtggcggcggtcagcgggttatcgcctgtgcacatgattgtcttgatgccgatggcgcggagacgtgcgaaacgttccgtcatgcccggctttacggtatcctttaaatagatgacgcccaggatccggttgttttcacatactgccagcggtgtgcctcccagggaggatactctttcaacatgggtgtggagatctgccgggattttgccgccctgctccagtacatattgctcaatggcgtcagaagcgccttttctgattttggaaccatcgggcagatcgacgccgctcatacgggtctgtgcggtaaactcctggaaggaggagccatcggtttccacgctgttgtcccccagacggcgtgccagctccagagtggatttaccctcgggcgtatcgtcatggaggctggtcaacgcggcgcagcgaatcagatcgctgcggctggcgccctctacaggaaagaagtcggccgccagacggttgccaaaggtgatggtcccggttttatccaaaatcatggtgtctacgtctccgcaggcctccacggccttgccgctcatagcaatcacgttgaaccgggtgacccggtccatgccggcgataccgatcgcggagagcaagccgccgatggtggtggggatcaggcaaaccatcagcgcaatcagcgtggaggtctggagctgcactcctgaatagagcccgataggatacaggcttacaatgacaatcaggaagatgatggtcaacgacacgagcagggtatttaaagcgatttcattcggcgtttttttacgggacgccccttcaaccagggcaatcatccgatccagaaagctgttgcccggctcggaggtgatgcgcaccttcagccagtcggatacaacggttgttccgcctgttacggagcagaaatcaccgccgctttcacggacgacaggcgcggattcgccggtgatcgccgattcgtccactgaggcgatgccctcgatgacctcgccgtcattgggaatgatttcgccggcgctcaccaggacaacgtcgccttttttcagctcgctggaggagacgatcgtctcgtttccatccgcgtccagcagatgggcctgcgtttccttctgcgtttttttcaagctggcagcctgcgccttgccgcgtccttcggccacagattcggcgaagtttgcaaacaggacggtgatcagcaggatgatggaaaccaccagattataagtacgcacgctgccgtcggtttcaccgagcaggccggggaaaaaggtgagagccagggtgataaaaaaaccgatctccaccacgaacatcacggggtttttcatcatatagcgcgggttcagcttggcaaaggagccaaccagcgcctgccggaaaatttccggcgttaccagtttctgtttactgctcatttttatctacctcccatcaggaccaaagcgtcaaatgctctgcgattggccctaaagccagcgcagggaagaaggtcagggcggcgaagatatataccacaaagaccaggatcactgcgaaggaaaccgtctcggttttcagtgtaccgaccgactcgctgacaaacctctttttcatcagtgagcctgcgatggccaactgaatgatgatcgacagataccgtccgaagaacattgcaagaccggctgtaatattccaaaagtagctgttgtccgccaacccttcaaatccggaaccgttgttggccgccgaggaagcatattcatacagcacctggcttaatccatggaagccggggtttgtgatgccctccagccccgcagggacggctaccgccagcgcagagaaggaaaggatcagcagcggatgaatgataatgcaaagagcggtgagcttcatttcgcgcccctcgatcttcttgcctaagtactccggcgtgcgcccaatcatcagcccgcagataaatacggcgaggatggcgtacatgatcatattcatcaatcccacgcctttaccgccgaatacgacgttgagcatcatgtgaagcagcgggaccatgccgcccagaggcgtcagggtatcgtgcatgttgttgacggtgccggttgtgaaggatgtggttgttgtggtaaacatcgccgactgggcaataccgaaccgcacttccttgccctccatgctgcccatggactgatcgagacccacctgctccagcgccggatttccctggctctcagaccagaaacaaacgctcaggccgattaaaaagatgattcccattgccaaaaagatcgtgcggccttcccggccaataatcctggaaacgagagaacggtctttcgtgtctgcctgttcgttctggccggctgcgcgggcgcgtttgctgtccagcaccatcttgccgaatgtaataacgcaggccccagggagaatcatcatcgaatataattcgatcagattagagagaatggttgggttttcaagcggcgtcgacgagttggcccccaaaaagccgcctccgttggtaccgagatgcttgatgatttccagcgccgctatggggccctgcgcgatgatctgtttggtaccttcaatggtagtgactacagtattggcaatgaaattctgcggaacgccctgccataccagcagcaggccgccgacgattgaaaaggggatcatgatacgtgtggtaatacgcacaagatccacaaagaagttgcccacattctccttggtccgtccggcaagcccgcggataaaggctacgcaggcggcataaccggtcgacgccgatacaaacatcataaagatgatcaccagcatttgggagagatagcttaggccgctctcacccgaatagtgctgaaggtttgtattcgtcataaagctgacgatcgtgttaaacgcaagcgtcggctccatatcgccgatgccgttcggattaaaaagtccaatgtgctgaatacgtaaaatgagatatcctatgaataccataacggcgtttgttcccacgagggcaagcgcgtactgtttccagttcatacccctttggggattgacgccgctgattttgtaaataagtccgtcgacccggtcaaataccggatcggcaaaggtgtgcttcccagcggcgatatgatacatataccgccccaccgggatgacgatcaacagatatataatgatcgtcagcgcaagctgcagcataatcgttccctcctacttgactattctgatactaaaatttttccgggtgtaccagggcgtaaaccagatatacgcccatcagcagcacgatgccgcccaatatcaacatataaatcctccgttccaccgcactgcgcggtatcaatacaaatgaaagctcccccacggacggggatttttcctaccgcttttctctttatctcaagccggttactcctggttgtcattttgttgctggcaccatttggtcagcagccagaccagcccgaaacagacagccagcgttccgaccatcaagagatccatcatatgcgatacgccttcctttcctgagacattccgccgcgctgtgaacagggtttcccatatgctttaaaagcacggcaaggcttttttgttgcccccatagtatactgcaagccgtaataagcggggattaagggttttgacacggcgttaagaaaaaattaattttttgtccgcatcggtcactccaagccccgtcggtcgacagcggggagtgtaaaacggaataccgttcccgacggcctgttgtcggatacggtgatttgcccgttatgctgggcaatgattgaccggcagagattcagccccaatcccaatccccgctgacaatccgaccggccttgctccgcggtgtagaataaatcgaacagatgctttttcgcttcgtccggaatgccgggaccgtcgtcggaaatggatacctccaccatgtcccccttacgctcgccgcttaaaacaatgtgcgagccgttgggggtgtattgaatggcgttattcatgatgttgatgataacacgcaggatcagcttcgcatttatatttgccatcaacatcgggtcctgcagcacaatcgaaatattatgttcgcgcgcccggcggtccaactgcgttgccgcactttggaatatatcctccaaaagctgcggctccatggggagggcgcccttgtccgcctcaaggtgcgtcgctgccaacaggttttcagtcatactgatcagccaattcgtatcgtcatagatgcctgtgtacagtctttctttggccgcgtcatccagggggcattccttttgcatcaagatggacgcgctgccgctgatatttgtaagcggggtgcgcaggtcatgggatacggcgcggagcagatttgcctggaggtgctccttttgcgcctgaagcgcggcctggtttttttcctcctgcaagcgcagacgctccaggcttaaaccgcattcgcttaaaatggcgatcataaaatttttctcagaagcgtctgggatgggatatccggcgatcggaattcccacaagccccatggcgccccgcgcaccgcggacagacagaaacagccatttggaatccggcaatgtgttcgtcgtggcgccagcgtgtttattgtttttctggacccactttgccacgccgatttcctcggtggtcaattgcttcagtacccgtttttcgtccgccggctccacacgaaacgacagattttcatccggatggtttaaactgtataaaacgggccggtcaaaaagcctgttcaattgctctgcggccaattgtaagcattccaactcatttcggccctgctgaagcttttgactgctttccagcagcaattccgtgaaataacttttttgcgccgtcaactgcgcctgcgttttaacctggcttgcaagagagcttgcaatgaagctggaaagcagcatgatcagaaatgtgataggataacttggatcggtggcctggaaagtgaattttggttcagtaaaaaagaaattaaaggcagctacgcttaaaagcgagctgacggcgccatacaggtgtccgtttgtccagacggccgttaccagaacacccagaataaaaaccgtgatgatatttgattcgctgaagcctgcggaataaaaagtgaagcaaagcagggtggagatgagcagaacaagcagcattttccccgtgtccttccaggaaaacacaagctttttcctgtggatttttcccaggggttttttataaaggggctgttgatcagggatgatataaacatccagatcggtcagctcgattaaacggtcggccatgctttttttgcgggttatagaattagaccggtgattcatgcgccccatcacaattttcgttacgccgctgacacgggcgtattcggcgatctgtaccgctggatcggtaccgtataccgttgcaatctgagcgcccaattgttccgccagacgcaggttgcttctcagccgtttgatgttttcgccggacagctctttggtttcaggcgtctgtacaaaaagagctgtaaagccgctgtgaaaggcctcggccatacgcgcggcggttcgtatgaccttggcgttggacggcgccgaggaaaggcaaatcaggatatgctcccccgcacgggcggtttgccccttccggtcatgcacagccgcccgattaagccggtccgccgttctgcgcatggcaatttcacgcagcgccgccaggttttccgcggtaaaaaagttctcaagcgcctgtttggcctggcgttcccggtagactttgccggcgcgcagccgtttgaccagatcatccggttcgatatccacaagctccacctggcttgccaggtcgaacacgaaatccggtatacgttcgttgaccactacgccggtgatggaagaaacaagatcgttcaaggactccagatgctgtacgttaacggtggtgtaaacattgatccccgcccgcagaagctcctctatgtcctggtatcgcttggtatggcggcatcccggcgcattgctgtgcgcaagctcatctacaagaatcaattgcggcctgcgctgtagggcgctgtccaagtcaaattccttcagtttgattccgcgatagtcaatttccttgcagtcaagcacctccagaccctccagcaatgccagggtgtccggacgggtgtgccgctccacatagccgacgaccacgtcgattccctcgttttttgcttgatgcgctgcttccagcatggcgtaggttttgccgacgcctgccgcataaccaaaaaagattttcagctttccgctggcggcgccagtcaccgtttcattattttccagaggcgctgacggatttttataatgttcatccatatggttctccttccgtatcattggagtggcgcaatgtctttttataattaagatagcacagcagacccaatgaaagcataaatcttttttgttttacattaagactatataaagacggtgtagaaatcccataccacagccttcccggcttagaaaaaccaccttgagccatgctgtcaatggatcaaggtggagcgggttcgttgaaaggataacatttaataattatattgagcggaaatacaaagaaaaagtccccggtttcctttttgaaaagaaaaccggggacttttgtcaatagagccgcagcgattggtcagtttggagcggccaacagtcccagacaaggtaaaaggtcagagcgcgcattggcaccaggtccttgcctggtgcgggaaagccatgacttcgggcgaaactgatttataagggtgcggtctcgccttgatggcacattccgcatataaggaggaacgagagagcggatggatggcttattttctgcaaaaggcaaaaaataagccggagcaaagtggactttgctccggcgtggtgccgctgaccgggatcgaaccggtacggtgtcgccaccgagggattttaagtcccttgcgtctgcctattccgccacagcggcataaatcttgcctccctctaatgataaacgattgtcggctaatagtcaagccgttgaagcaattccgggcatggttatatgcttgcaggaaaagggttgtgaatgcaggtataccggtacatttagaaggaataaatttgggttatcgaactttcatatagtaattttctgccgaatatgataatatagattatcggttgaaaccatgggacggtcaaaaacagattatgggaggcagacgatgattttcaaaaagaagtcgtattacgatgagatgccagagacagaaacagtaaacggggatacgcccgcacaggcacagcaggaaataccggccgagccggcgccggcctccgttgcacccactgggccggccgcgtccgggcagtccggcaaggaggatgggagcatgaatgaatcggacctgaccgcttcaatttccaaaaatacggttgtcaagggcgatattgcgaccaaggataatctggagattttcggccatgttgagggcgatgtgatcagcaaagcggtcgtgaaggtctatggcgttgtgcgcggtaagatctgctgtgaaacattcgttgcgagcggcgcgaaaatctgcggagatatcacctgtacgcattcggttgtagtgcgcacaaatacggagatcgagggtgacatcaagtgcggttcggccaatatcagcggaacggttttgggcaatgtaactgctggggagatggtttctctcagcgagacggcgtctgtaacgggcaatgtcatcgctgctggtattgaagtcagcaagggtgcgattctcaacggctctgtcgagacgcagaaaaaggagccgcccaagccaaaggaaaaagtgaaagcagtggagcaaaaagaaaaagtggaatcgaaaacggagacgaacgccgcgccgtcggctgagaggccagccggagaggcgcagaaaaccgaggaaaagattccggccgcagcggccaacggctccatataaaaaagaaccggcgagaccgccggttctttttttatggcgtttcacgacttttatttacaaattgcgctttacatttaatatagaattctatacaataaatttattcatatttttatacccggccccgcccggcgctggcaaaggatatccagaagctgccaggcggggcgcggaccataaagagaggggtttattatgccgcgcggacgcaaaaagacggtcaatttgtcctatgagcagcgtattgaagaaatcgagggaaagatcgaagcgcacaaaaacgcgatttctgatttgaaaaaggaattaaaacggttgacggctgagaaagagcaggccgatttggagaagatctgcgcgcttgtaaaggcgtcggggaaaacacccgaggaggctcttgccgttttaaagggagaggcatagaaagaaacggccgtgtgcggccgtctgttcctctttacgctggtttttattgacgaacaggtcaatttctgttatagtcaaagggaaaacaggggagccaaaaggctgagaatgagtgcaccgcattctaaaccctcgaacctgatacgggtaatgccggcgtaggaagcatatcgacacgattttgtgccagtttgttgttttacaaggggccgtaccaggggtgcggccttttgttctgccctgccatacagtccgcccgaaccggcgcagccgcgcgccggttgaccgtgacagacgctgtaacagaaaggaagaacttgcaatggggtacacaacgcagatgaacgccgcaaggcagaaaatcgtaacgaaggaaatgcaggctgtcgccgcctgggaagggatcggcatggaccggcttttaaagctagtcgcaaacgggcaggccgtcattccggccaacaagaatcataaatgtttaaagccatttggcatcggcagcgccctgaaaacaaagattaatgtcaatctcggcacctcccgcgactgcatgaatatggatgtggagcttgaaaaggtcatgaacgccgtcaatatgggcgcggaggccatcatggatttaagctcgttcggcgatacgcgcgtattccgccgcaagctgactgcggagtgtccggcgattctcggtacagtgcccatttacgatgcaatcgtctattacaataagccgctcaaggacatcaccagccgggagtggatcgacgtattcaaaatgcatgccgaggatggcgtcgactttatgacgatccattgcgggctgaacaggagcacagccgcgcgcttcaagcaatccaagcggctgttgaatcttgtttcacgcggcggcagcttaatcttttcatggatggaactgacaggcaatgagaacccatttttcgaattttatgatgatatactggaaatctgccggcagtatgacgtgacactgagtcttggtgacgcgtgccgccccgggtgtatcgccgatgcgggcgacgtttcacagatcgaggaacttgttgtgctcggtgagctgacggcgcgcgcctgggaaaaggatgtgcaggttatggtggaaggcccgggccatatggcgctcaatcagattcaagctaatatggaaatccaacaaacgctctgtaaaggcgcgccgttttatgtcctcggtccgcttgttacggatatcgcccccggttatgatcatatcacagcggcgatcggcggggcaatcgccgctacatatggcgcgtcctttctttgttatgtcacgccggcggagcatctgcgtctgccaaccgtcgaggatgtgaaagagggaattatcgcctccaaaatcgctgcgcacgcggccgatgtggcaaaggggctgcccggtgcggctgactgggattacaggatgggacaggcgcgccgcacgctcgattgggagcgccagttcgagctggcgattgatccggaaaaggcgcgccgctatcgcgctcagtcgcagccggagcactcggatacctgtactatgtgcggcaagatgtgttcggtgcgcaatatgaacaaaattttaaacggtgagaatgtcgatattatggaataaccgccttttcgccggagaggagagccgatggacaagctgttggcccggtcagggcttctggatggaatcgatgaaaaggatctgacgcatctgttcggctgtacgggcggccgtgagcgttcgttcagcgcgggggagccgatctgcgaggaaggcgggcgcccgtcagtctgcgtgctgctcgcgggctgcgcggcgtctgtaccggacggcatgtcccgcgtgttcgaaccaggcgatgtgtttttgtgcgatggcgcttccatctgtgccagggcgccttcacgcgctctggtgttccgcgaggaccgttttcgttgtgtgtgcggcgcttcatgcgcctatcaccgccggttggtcgaaaatcttgcaagtctgatttaacagcagttcgttaagcaaatccgcgcggcatttcagttttatctgcgccgcgtatcgcggcggaatggaggatttttatgagtctgttcagcagaaggccttcctttcaggaaggtctggaaacgtttcaaaaaacgccgggcgcggtgcttttggatgtgcgcacacctgaagaatttgcggcaggccacgttccggaggcggtcaacgcgccgctcgacgctttggagcgtatcgattaccagcaggacacgccgctgtttgtctattgccacagcggcgcgcgcagcgggcgggcatgtattctgttggagaaggcgggatatcatgccgttaatatcggcgggatcgcagaatataccggcaggcttgaccgctgatccgattttttgtttccggaactctgaaacgcttgagaatttccgctttttggtgtatgatgaactcaggagctgcaccaatgggagacgtacatgtcttggcggaaaatttcccgttcggatcgggtgggaaaagcttgaaatccgtcaggattcccacgttttccttccttgccggataaaaaacttttccgaagatccatgcgtttttccaattggtacgcttcttatccgaaaacagaagggcaacgcgtctggcccggtttaggagcgagggacggtttcagagcaaaagaccgctatgatcggagggatgactgtgaaaaattatgtgatcacaattgcaaggggatatggaagcggtggccggaccatcggcaaaatgcttgccaaggagcttgatattcattactacgaccaggagcttctgcgcatggcgtccgatgaaagcggaatcagcgaatcgttgttcgcgcgcgctgacgaaaaattaaagacgccggtgctctttaaggcggggcgcaaaagcgcctacacgggcgaaatcatcccgcctgacagcgtggattttacctcggagcagaatctgttcaactatcaagccaaggtaatacgcgatttggctgaaaaggagtcgtgcgtcatcgttggccgctgcgctgattttattcttggagagcgcgaaaacgtcctgcgcttgtacgtacatgcgccctttgagtattgtgtgaaaaaggcgatggaagtgcacgcctcgtttgacgaggaggaagcgcgccggtatatccgccggattgataagtaccggcgggattattaccgctattttacggggcgcgactggaacgcggccgaaaattatgatctgtgtatcaacagcagcatgcttggatgggataaatgcgtcgcgcttgtcaaggcatatttggagattaaaatggcataatcgctttgccatgaaaaaggggcgttcggggacggattttttagccgcctcccggacgtcctgttttttcgcccggccaaaatataatcctgtttgtttaaaacaggacttctatccggcgctgccgtgttagcacataaatatagggaccggcttgctgctttgttcagagattattcatatatttgtataaatgtgtttgataagtggaataaaaattacaaattggttacaaaaagcggatgaaagattacaaattggttacaaaatccgttgactttttttgtatccctggggtataataggaacagggaaggcttggactttcccggggaggcccacatgaaacgattgttttgtctgctgctggttgttgtgctggcatttggcgccgcgccgctaggcgcatccgccgcatccgccgccaacggctcggtggcattgcaactgaataacgacggtgcggcggagctgattgacgccgacggcgcggttcgcgcagtcagcgatccggcttcctccgacgcgggcagctttaaatttgaagctgcgcccgatcagacgctgtatttatgcctgggcgtctctgacggcggcgatatgtccatgctatggaatgattccgtgggcgatctgaccggtgtggcgtcgcccggcgagctggcagatcaggagctgtttaagctcaaggtcagccgcgacggagatggagcgcgccttgtgcgtgtttcccagtacaatgagcgagccatcggcggcagcgcgcgcagcgcatggctgaaaatcgatatcgcggcaagcgattcgattgatgagcagaaagcggttgtggatctggcctttactgcgcgtgacgacgatgaaaacggcaaatgggagaagggcgattatgcgcttttgcgtttgacactgtggattggcagcgctgttgaggagggcggggacgccctgcgcgccgcaggggattcgttcgtttacaagcctgattccaattcagagaacatagtgacatgggaggacgtggcgtcactatcgttttccgcgagcgacgatgcgaaaaagttttacgcccgcctttctaccaagcacgatccgatttatgcggcgtatgaggacagcgcggatctgtatttccgcaattttaccggcgcgcccacaatttcagcgtcctcccgtgcgacgttgacgttgtattatccgtgggaggatgggggtcccgatccggcggcctgccacgtctatctggcggatgcggacggctcactgcgcgatgttacaaagctgtttacctatatcggagaagatgaggatggcagcgcggtgaatggctggcggatacgcacacgtacgctgggatgctatatcattgcggaccgcgcgctggatttgactttgcagcaggaacaggctgtccaaacgcagcctgagacggtttctgtctcggaacaggcttctgtgccgcctgcttcagagaatgctgcagcattgccgtttgatatcaaccgcaatgcaaaaccgatcccgaatacagggatttaaaataaacgcaaagcgtttattttatccttcatggcagggcgatacgcgggcgcagcccgctgctgccctgatggccgattgtatcatgccgcgctgcggacatgatacaatacaacgcgcatggtctgcctatgcgcgttgtattttttattgcgaaaaaacggcctgtggattttcattttttggtacgcaaggatgttttttgtaggaagtatttaaaaggccgctcctgtttttaaagtcggatttgacagtgaaatggttgctttttcccgggcattatgctataatccatatacttcacgtaatgattgattggttcataaacgcttgtttaaaaatttttatcctcctgcctgcacttgcttattacacagaaagtcagaggcgggctgcctgaatctgacgaggagaatcggctgcatacattgggggaaaacatcctttaaacaggacttttttgttatgaactcgacctgagaggaggccccaggtatgaagcatttgtcatcctggacgttcgcagcttgtatggctgtttgcgcggcaagcgtaactgtcctggcttatgcgatcagcacgacaattgatctgacgggcacggtgtatgatgataacgggaaggatgtaactgcaaaatatgaggtcttgttcgacgagggaaatgtaacgatcaacagggcgcctgtcggtgaaaagctttattttgagattggcaatggaacagattttcgtgttgtggaaggaatgactgtcgacgctgcggcgcttgcaaacagcgataatttttcctacacgcttgaacgcggcgaaaatggagacttgctcgattatgccaggcttgtaaccaagcggttcgatgatggggaacgaaagcgttattttgaaattgcgcttgtagttccgcaggaggatcaaaagcaggctgttacatttgatctttcctttaaggcaaagcacacggaggatcattattggcaggcaggggatacggcgtccatgcatttcgaattttggatcggcgatgctgcccagcagtcatcgtccgaggaatcccaagcgcctgcatcaagctccagcctggccagtacgccggcagcttcgcagactgcatcggtaccccccacccctcagagcacgcccgaggaggctcccgctccaaccggatcgcatgacttaacggctgccgccgcggccttgatggctgtgtcggctgcggctatcctgttggtgaataagcgccgttaaggttatacacgcgtgcgcgtatatagaagtattgcgaatacatgatccgctggactgcatggtccagcggatttttgtaagcagcgatgtctgaaggcggcaaaatacggcgccgctgggaaaattcagggtgatttcgcggcggctgtatcgaactggaaacggagtattctatgggcatccagatatgtcggccatatcatggatttttgattttttaaataatatttttgataataagttgattgtttatgttaaattttaataataattatgacaatttggtaacaaaaacctcttgaaaaaagcttgttttgcagatatactaagtctcgttccaagcggctcggatgcgccgggccggagggcaaaacgatttttcaggaggaaccccaattatgaaaaaaatgcttgcagttatgcttgccgccgccacgaccatgtccgttggcgtgacagcttttgcaaatgacgaaatcggcaacggtaccgccgttgtttccagctatgccgacctgcttctcgattccggtgatccgggcagctcctcgagcgacgcggaggacaacagctcctcgagcgattcttcttccgaagacgagtccgtttccctcgagaacgcgaccgatgtgaagatcggcgctgacgaggacggcgttgtgctcggcgacgatgttctcgagcctggcaaagagtacaagttcccggtcagcctgacggttgacggcaaggacaccaagatcactgaggaactgatggacggctacaagttcaactattccaagatctcctccaagggcatgagccgctttgagattgaggagtacaagggccagtactacctgtacgttgaggcgcgcgacactgtcgtgaccaagccggttgacgtgaagtacaatgtcaagctggtgcgcaaatcgaacaacctgtccgtgttcacacaggaagtcaagttccagtacggctacgaggaagcgaacggcgattacatcagcggtctcgacaagggcgacgtcgttgagatcgacaacgaccgtccggtcatcaccgatacgcagttcgacaagatcgcgaagatcaacgattacaaaaacgtcaccctgtccggcagcggctgggagttcacggtcaacgtgactgacgagagcaccaagaacatggttcacaacaatgcgggcatcaaagaggttcttgccaagtatccggatcaggacttcaagttcttctccttccctggcaagccgtccttcgcagcgaccggccgtatggcgctcgatgttgacgatatcgtcgacgatttcgagaagatgtacacctaccgctatgcgaacggcaccatctaccgcatcaacgcgacctttgacagcgaggaaaacacgctgaacttccgcacgaacaagctcgacaacttctttgttacgaacaagttcatcgaggacggcacggttgtctccaaggacgacgtgacggattccgacgatacgacgagcactccggacgagaacaagggcaacccgtccacgggcgccagcgacatgatcaacgctgccgttgcggctgcgttcgctggtctggccggtgtcggcgctctggctgcgaagaagcgctccaaataagaatttgcatccgcacagggataaacccacgcgaatgaccaggataggaccgccggcccgattgggccagcggtcctgcttatataggaataagagcggtgaaaacagggtgcgccaaggacattggaaggagcgccgcacagatgtatccagaaccagatacaacattctggaattttgataaaattaataaaattatatattttaatattgatttaaatatataatttaaacaaaaataatgacaatgtggtaacaaaatcctgttgataaagcgtataaaatcagatatactgagtctcgttccaagcggttcggatacgccggaccgaagggcaaaccgatttttcaggaggaacctaaccatgaaaaaagtgcttgcagttatgcttgccgccgccacgaccatgtcgatcggcgtgacagcctttgcgaatgacgaaatcggcaacggtaccgccgttgtttccagctatgccgacctgcttctcgactccggcaatccggacagctcctcgagcgatgcttccagcgacacctcgagcgacaattcttccagcgatacctccagcgacaactcctccagctcttctgaggacgagtccggcgacgtttcccttgaggatgcgaccgacgttaacatcggcgctgacgaggacggcgttgtgctcggcgacgatatcctcgagcctggcaaggagtacaaattcccggtcagcctgaccgtgggcggcaaagccgttaagatcacggacgagctgatggatggctacaagttcagctattccaagatctcctccaagggcatgagccgctttgagatcgaggagcacaagggccagtactacctgtacgttgaggcgcgcgacactgtgaccaccaagccggttgatgtgaagtacaacgtcaagctggtgcgcaaatcgaacaacctgtccgtgtttacgcaggaagtcaagttccagtacggctatgacgaggccgacagcgattatatcaacggcctcgacgagggcgataccgttgaaatcagcaacgacaacccggtcatcaccggcacgatgtttgataagatcgccaagatcaacaactacaagaacgtcaccttggccggcaacgactgggagttcacggtcaacgtgaccgacgaaaccaccaagaacatggtccacaacaatgcgggcatcaaagctgtcctggctgcgtacccggatcaggacttcaagttcttctccttccctggcaagccgtccttctcggcgaccggccgcatggcgctcaacgttgacgatatcgtcgacgatttcgagaagatgtacacctaccgctacgcgaacggcaccatctatcgcatcaacgcgaccttcgatggcgatgagaacacgctgaccttccgcacgaacaagctcgacaacttcttcgttacgaacaagttcatcgaggatggcaccgttgtttccgatgctgaggataccgatacggacgatacaaacgattccaacaacggttcttcctccaacccggacaagaacaatccatccaccggtgccagcgacatgatcaaccgcgctgttatggctgcgttcaacgatctggctgaggataagaaacgcttctaaattctaataagcgttttataaacagagaaccggcaggttaacgcctgccggttctctgtttaatcgtatgtagcgttaagccgctggcataatgaacacctggcctgtttcgatcagattggggtcgatgatttgcgctttattcaattcataaatttccacccaccggaatccatcgcctaattggctttgcgcgatattccatagacaatcgtttgtttttactgtgtaattttttgctgaagaagcggcgccggcagaatctgagccagtggaaacatccggctgcgtatcgggttttgaagcggtcgcacttccgctttcgttggtatccagggccgggagcttaccttccgcgcgaagcgccggaccgttgagagaagcgacattcggagtacggccgtcctcggaggcgggaatttgaatctcaccggaccggactttttcataaatcaaatccttctgcgcgtcatccagcggcgcgccgatgattttccagttgttgtcacaaactggcatcagcggctctgacaggcctgcgacatattctgtgatcatatcgcggaccgcgccgccctcatagacaacatcggattcctggatcagtcccgctgaaacaaggccgccataccgatagttatttaatgcaagcaccagagactggtcgtcgcgcagaggttcaccttgataagtgacgttgacaatccgggagccttccggcttggaaatatcaatttcgtaattgacacctgcaaacatatcgtagttgtacatacggatgtcaggattgaaactgatggtaacatcaccgggctgatattgattgaaaaagtttcccgcttgttgctccatgatttttttcagttgcgcaccggttaccttcaccgcgaacagcgtgttatcatatttatatatttttacgctgtcccgatgtaaaaatggaccagcggtcaggttggatgaggcgtcaaacaaagcagcgagagagacatcggctccggactctttcatttggacgatattgacaagatctgtgatgggattatcctgcacaatggccgctgggattccgggaaggatttcaactggatccataaaggtttttccaacttcccccactttttttccagcgagattccggctcttggtgtcaagatccttaaacgcagcgaggaaagcagcattgggggtgacagtggacgtatccagcagggtcgcctttgtagcagcgttgttcacgacccactttccatctttattttccacctcaaataccagcttaccgacatactggccgttattggcgggttccagcaccggaacgccggcaatcgcttcttccactgtcgcatgcgcgtgcccgatgaggagtgcatccagacggtcagcatacttagtggcgatcgattccacgccggcgctgccgtattcaccctccagcccataatggatcgcgccgatgacaatatccgctttgccctccagctcgttcaggatttttccagtttcatcaatcggatcggtaaacttcatattgttgtaatgggtgggatcggatttttcccattgcggaatatggggagcgtcaattccgaatatggcgactttgacaccttttacgtcaaaaatctgatatgcgctttgataccgtgaaccgtccgccttatagatgtttccggccaacgtaacgccatcaaattctgaaatggctttttccaagctgctgaattcaaagttgaactcatgattacccagaacccacgcgtcatattggagatagttcagagccgcgatcatcgggtgagggacatcatttcgaaactcctgaatataattggcttgaaggctatctccagtgtcaatcagaagaaggtcgggatctgttttgcgctcattttccacgatggtagcaacatgcgccagactggattgggtttgtacatttgaggcataatcaaaaggatttaccatgccatgcagatcgcttgtttggagcacggtaactgtaaccttgccgccaggttcggaggccagaacatctgccgatgcgcccaagaccatgacgccagtcaatactgccgccacaagtttcctgaaaagctttaccattgaacattcctcccgttgccaattgtctgttggacaaaagtattactattattatagcgagaatttggtaaagcacaataggagttcagtaattaaaatcattttatcatttagagaaacaaaattttggatattgtgcacaatagagatgggcggaattaatagaaatcagatatcgcattttgcactatgagcggcgtctcatcaatagccgctggacgttttgaagcagcaagcggaaattgagcgcggttacaacaaggcacagtccgatttcaggcagcagccacccggtttcaaacgtcagcagaatataggtttgcacgccgagcagtgccagatttaaaagcagtttaaacggatgccaatgtagcggtacgatccgccgtgtatcgatgatgcgtacagtgaacacaacaagatagccggccagcgtggccacgacgccgccctgtaccccgaaattggggatcagcgtcatattcagaatgatattgatcccggcgccgagcgccgttgtgacaagcgtggcgaagctttttttctcaagcatatagatggtcccgagaaaggatacgaggcaggaaaacgacgtggccaacaataaaacagggatgaatctccaggactcatagtattcgccgtatgccagaatacggttgatccacttgcatagcaggatcagcccggacgcagaggtaaagatcagagcctgatatgatgcaaatacgttgctgaaaaagcgggtacgtccctgctggtcctctgtaaaggcggaaagctgccaggcatcggaaaagatcccggcgagcaggttgatgatggtgggaactttgtatgcgacggtgagcagaccgttggccccctgacccaggtaataggcgataaagaaggcgtcggaggcgtttgtgatccaccagaagatatttgtcgggatcagcggcaatgcgtaacgcaccattgacgcggcgaccgaccagtcgcagccgaaaaaacggatatacctgcgcagattggctatggtaaaaaggaaaagcgccgacagcaggtccgagagaattgtagcaagcacatagcccgtcacgccgagcttaaatacgacaagaaaaaccacattgaataaaatgaccgtcgccgtggccataacgccgtcaaaggcataaagccgcacaagctgccgcgcgcgtacaaactgtgagcagagcgaacgcaggcaggcggtcagcacgtagatataaacaagataggcgtttccatcaagcagatgaaagcgcgcaagagcgggatagagcagcagaaagatcagatagccgctgccgatcgccgtcagcgcgccggtgaacacatcgcgcttatcgttggcgcggtcaagtccgaaccggatgattgcgtttgacatgccaatcgatgcaagcggaatgatcagattggccgtttttacaatcaggtcgcctgtgcccagctggtcagtggtgagaacgcgcgtataaaaggggacaagcagaaaaacgagcaccttcgagctgaaggtgccgattgcaaagatcagcgtattggaaatgagttttttatacttgtccaggtcgccgcctccctgcgtgtttgtcggggcgttgtgcccgcttgtgatacatgtcagaacagccttagaaatccaagcagtccgtaagcgccggccgtcatgataacgccggcaattaacacgccgcctgtaattgccagcagcgcgtttttcatgcgcaggccaagcagcgcagcgagtgccgcgcccgaccatgcgcccgtaccgggcaaaggaatgccgacaaacaggcacagcccgatggtttcataacgcgtgaccttgtccgcctttgacatcagcttcgcctcatatttggcggtgataccagaaagcagacgcgtcgatttaagccacttgaacagcggccggccaaacagcacgataaacggtaccggcagcaggttgccgacaaccgaaatcagaaatacgacgggccattccataccaagcgccgcaccgagcggaatcgagccgcgcagctcgatcaatggagtcatggagacaatcagcagcgcgacctcgcgcccggctcccgaaaaaaagtcaaaaatttgctgcataagctgatccataaaagtaaacagttccgccctttcctgtcagcgcaagcgcccggtcgggcgctgcatttgccgccggcgctttgcgccggcggtctgttttttccattatagtcaaattatgcgcaaaaggcaatcggatattgcccgcgtatcgaaaaaatgtaaggggttaaagcgcaagctttaacagacaagcggcatttttccacaggatgttctcaagatcgctgccggtcacgcccacacggcgcagcagcgccagttcatcgggcgcggtgctccaggggcagtcggtgccgaacagcacatgatcagagccgcgtttatacaaaagcgcgcgaaatgcgtcagggtccagcaggggggcgctcatggccgtatcgaaatagacgttgtccaacccgcacagatgctccgaggcgtcggcacagtcgccgagcgcacccatgtgggcggcgataattgtcagacgcggaaacgcgcgcgcgacgcgcgcgatttcctccgctggcgcgcggttggcgccgggcgcgacagggtcgcgtccggcatgcagcaagagcggcaggccgcagtcacagaccgcctgataaatggggtagtatcgttcgtcgccgaactgaaaattttgatacgccggatgcagcttcacgccgtacaaaccggctcccgcgatctccgccgcgacagcgggcgcatcctcgtcggcggggtgcaggcttccaaagcagagaaactgcggatgcgctgcctgcacctcacaggcaaaggagttgatgcggcgggcctgtcccggctttgttgcaatatgcagcacaacggaataatcaacaccccaccggcgcatggcctcgagcgtgccggtttgggttccgtccgtatgataggggatgtcgtgcgcgattttggacagatgcggcagcgtgcgcggggcgagagaatcggggaagatatgcgtgtgaaagtcaatgatcataaacaatcgggcctttccagaaacaagtttatcaataagcggcgcacgggtgggaacactgttcatacagacccggccgtgagcaacttgacagcagatgaacaacaaaagcctgaacagtctgtattatagcgcattgaacagcccttgtaaaccagccgttaattggtccgccggttaggacgcaattcaaatagccgccgcgcccgaaagctgtttgtaaaatcaaaatttccgtctttttctgcaaacagcggcgatggccgcattaaaaagctccggaatccgaaagaattcctgacttttccgccttgcattctcccgctgtttgcgaacaatccggcaactcatctatttccaaacaagccctgattattctgcgataaaacagcggaaaaatacttgacaaatagatcaattgggtatacaatcaaaacacccccacccccagggggtgaaaggatggacgtcatgaaaaaaacatttgatgtaaccggcatgacctgttcggcttgctcggcacatgtggaaaaaagcgttgctaaggtggcgggcgtgcgctccgtcaccgtcaatcttctttctaataatatggcggtcgattacgatgaaagcgccgtcaacgacgctgcgatcattaccgcggtcgagcacgcgggatatggcgcttcggtgcgcggaccggcgcagacggcggcgcacagcgcgccgcgcgcggccgctgatccgatgaaagatgaaatcaaaaatatgaaacgccgtttaattgtatcgtttatatttttgataccattgttttacatttccatggggcacatgatggggctgccgctgccgcatattcttcatggcaatgcaaacgcgctttcgtttgcgtttacacagtttctgttgacgctgccgatcatctatgtcaaccgcaaatactatcaggtcggttacaagacgctgctgcgcggcgcgccaaatatggattcgctgatcgcgatcggctcgacggccgcgctcgtctatggcgttgtggcgatctatatgatcggatggggcttgggacacggcgatgcggatatcgtttcccggtattcgatggacctctactttgaatccgccggcatgatcctgacgctgatcacactcggcaagtttttggagacgcgctccaagggcaagacctccgaggcgatcacaaagctgatggacctggcgccaaagacagccgttgtcgaacgcgacggcgtggaaacagaggtgcctgtcgagcaggtcactgtcggtgatctcatcgttgtgcgtcccggccaaagcgtcccggtcgacggcgagctggtcgagggcagtaccgcgatcgacgaatcggccatcacgggcgagagcatcccggtggaaaagcacccgggtgaccgcgttgtggccgcgaccatcaataaaactggctggtttaaattccgcgccaccaaggtcggcgcggacacgacgctcgcgcagattatccggctggtggaggacgccgcgaattcaaaagcgcccattgccaagcttgccgaccgcgtgagcggcatttttgtaccggttgtcatcggcatcgcggtgctggcggccatcgtctggttggcgctcggatattcggtggaattcgcgttgtcgatcggcatcgcggtgctggtcatctcctgcccgtgcgcgcttggcctggcaacgccggtcgccatcatggtcggtaccggcaagggtgcggaaaacggcatcctgatcaagtcggcggaatcgcttgagacgctgcacacggtcgataccgttgtgctcgataaaacaggcacggtcacggaggggcggccgcgcgtcacagatgtgctgacggcccccaatttttcagagaagtcccttttgacgcttgccgcttcgatcgaaaagccgtcggagcatccgctttccggcgcggttgtcgccgaggccgaggcacgcggcctgcatacggacaatgtgaccgattttaaagcggttgccggacagggcgtcgccgcgcgcgtcgatgggaaaatgtattttgcaggcaatccgcgcatgatggatgaaaacggcgtcgatatgggcggttttcgggaacagggcgaatccctgtcggagcaggggaaaacgccgctctattttgcggatgaggcgcatgtgatcggcgttgtggccgtggcggacactgtcaagccgacgagccgtgcggcgatcgacgcgtttaaatcgatgggcgtcgacgtggtgatgctgaccggcgataaccgccgcactgccgaggcgatccgccggacgcttgggatcgggcgcgtcgtggcggaggtgctgccgcaggacaaggagcgcgaggtcgcgtcgctccaggagcagggcaaaaaggttgcgatggtcggcgacggcatcaacgacgcgccggccctgacccgcgccgacgtcggcattgcaattggcgcgggcacggatgtcgcaattgaatcggccgacgttgtgctgatgaaaagcgacctgctcgacgctgttaccgctgtggaattgtcgcgcgctgttatccgcaatatccgtcaaaatttgttctgggcgtttttctacaacaccatcggtattccgttggcggccggtgtgttctattcgcttctcggctggaagcttaatccaatgttcggcgcagccgcgatgagtttaagctccgtgtgcgtcgtttcgaacgcgctgcggctgaagttgtttaaaccgcgtcatacagcggttttaaatacaaatagtaatattcaagaaaaaatcaacaaaaaagtggaggtatcggcgatgaaaaagacaatggtaatcgaaggaatgagctgcgggcattgctccgcgcgtgtggaaaaggcgctcaacgcgctcgacggcgtttcggccaaggtcgacctggaggctaaaacggccgcgattgagacagagggccgcgtgagcgacgaacagctccgcgccgcagtgaccgacgcgggctacgacgtcgtttcgctggactgatgcgggccgatcgtgaacaggtcgcacgcctgttaaaaacggcgcgcggccagattgacggaattctgcgcatggtggaggaggatcgctattgtatcgacatatccaaccagatcatggcagcggaatccatccttgggcgtgccaaccgcgaggtgctgcgcgcccatctggagggttgtgtgcgcgaagccgttgacagcggcagcgcggatgagaaaattggggagattgcggcactgcttgataagctggtccgctgattccttttgatcgaatgataccgttaactgacaggggcgggcgttgtctgtccctgtcagttagcgcaaaggaggactatgaatgaatgatgcggttttgattcgaaatgaaagagaaacggattatcaaaaggttgaagaaatcacaaggaaagcgttttggaatttatatattcccggctgcgtggagcattatctggcgcatgtcatgcgtggccatgctgattttctgccggagcttgattttgtggttgaaatcggcggacaggtgattggtaacattatgtatacaaaagcaaagctgattgacgagtgcggggaggagaaggagatcctgacctttgggccggtcagcattttaccggagtaccagcgcaaaggatacggcaagagaatgatggaatattcctttgagagggcggccgcgcttggctatgatacgatcgtcatcttcggcaatccgggcaattatgtaggacgcggctttaaaagctgcaaaaagtacaacatttgtatggaggacgggacgttcccggctgcgatgatggtaaaagtgctgaagccgggcgcgcttgacggcagaaaatgggtctatcatgacagtcccgccatgcatattgacgaggcgcaggcagagcagttcgatgccgctctggaatatatggaaaagaaggaacagccaagccaggaggaattttatatcctgagcagcgccgtcttaaaatgatcctttcctgcaaaagaaagcgttcccaatcagctaaaagggctgtgccgcgattgcggcacagccctttttacaagattcaagatgcttctttgtacaacctgcccgtgcatatgctgatatagagcggcgaaggggtgaaagtatgtatgatctgcataagcctgtgaagcatattttgttatttctgacaggcggcgtcctatattgcctgacagagcttatatggcgggggcatacgcacctttcaatggcggcgcttggaggctgctgctttctgatgatcgggcggatcaatgaggactgcccaagctgtgtctccctgctttctcaaatggtgctgtcggcgctggtcgtcacagcgatggaatttgccgccggcttggtgctgaacgtctggatggggcttgaaatctgggattattccgatctgccgtacaacctgttggggcaggtatgccttttgtatatgaacctgtggtttttgctgtctctgcccgccattctgctggacgactggctgcgctggcgctggttcgacgaacaggcgccgcactaccgcctgctgtgattttcccacagcaatcccaaaagggaaagccccggaccgccggacaggcaaatttatacggggcaattggctggctcacagttgccggtattatggatactgtgcaaggatctccggcacaaggtcgggggcgacctgtttaaacaggtcgttgtcaatgcgtgtattgggggcgctgccgcattgcttaaggcaattttgcgtatccagcaggaaccggccatcgtcagtgacctggcctgctttgatgccgagcgccgtttcaaacgccttgagcacggccgcgccgcccttggccgcacaacgcggacctgtacagacaacgatacggtgcgcatagggcgcggcgttcagcccgggcaggcgctttacaagcgccgctacggcggcgggcgcggttttcatggcggcggccgcggctgcctgcgcggccggcggtacgcagccgcagagagattggatttcacgcagcagtgcgatgagcagctcctgtccgcctgtttcgcggatggatttatagtacgtgagaagctcctggagctgttcctgttcaaatggtttcatggcatcctccgagaaagtccggagaaaaatccggaacagatatattaaaaagaggcatgtttaaaacatgcctctttttggtgggaacacggggactcgaaccctggacttcctgcgtgtgatgcaggcactctaaccagctgagctatgctcccgagatcaatgcaaatattatagcatgttttcggaagcttgtaaaggggtatttttacaagaaacagacgttcagtcgtattcctgcatcacattgccgatggtcacaattgaatgcggcgcccaaacatactgcccttccaacatgggtacagcctcctgggggtttgcgccggtggaaagcgcataggccagatcgaaaattgcctgcgcctgcccttgggcgtcgtttcgcaccgtgccggccagggagccgtcctgaattgccagaagcgcaggcggagtggcgtcgatgccgacaataacaggaagctcagagatttcagcggcgtgataagcgtcgatcgcaccgagcgccatgtcgtcgttgttgcagaatatgacctcgatgcggtcgcgcagctcctcatcagcaagccactgcgccattttcgcggaggcctgcgcacgctgccagttggcaggctcgctggcaagcttttcgacatcaatgccagccgaggtcaatgcggcaatgcagctttcggtgcgcagggttgcgtcctgatggcccggttcgccctccagtatgacatattggatccgtccatcgccgttgcggtcaacagacgcgggattctcatcataaaggtccacgacgatgcgtccctgcatatctcccgcctcgcgcggatcggaaccgacataataaacgttctgccaccgctgcatatcctcgccgaccggctcgcggttgaaaaagatgacgggaatatcggcggcgcgcgctttgtcgatgatgacggaagctgcggttcggtcgacctcattgacacagatcgcgtcatacccctgcgccaaaaaacggtccacctgctcgttttgagtcccctggtttccggtgccatccaaaatattgagtgtgatttttacgttgtcctgtgtctcccgtgctttggcacagtcgagcagatcggaagcaagcaacgaaataaacgtgtcgctttgccggtagagcgttacgccgatgcggatgggatcgggcgtcatggactcggatggcttgtccgcgcagccgctgggaagcagcaggcagcagaacgcgccggcaagcagtgcggcggccctgagacgagctttcataaacgtacctccttgcatctgcgatccgtcagcggatgaatgggaacaagagccgctgtacctcgggatcatacatattggaccagttgacaacctggtgcccgacaacggtgtccgcttccggaatatggccctgtatgctgtcaaccgcagccttgacgccgagatagccgacagcaaaatcgttttgcacgactgtggctgtgacaatatcgttttcaataaacgaggcgattttcccggtcgagccaattccaaacaggtcgagatagtgcgcctgcatatcgctgaccgcctgggcagtcagttcaagcgcgcttgtatcaagtgtgacaatcacatcggctgtctttttgccgatgcgtgaggcaagcatacgcgacgcttcagcgggatcgccgtccggcagagtccaaacctcaatttcgccgccgatacgcccgagaacatgcatcagtccggcccggcgctgcgccacgctggcgcattgcaggctgctgtccaccacaactaaacgtttgcgcgcgtttccactggcgatgatttcctcaccgagctgtaatcccatcccatagttgtcggccgaaatatacgaggagacagaaccgctgtaaacacccgtttcaatacagatgacgggcgctttttccgcggcttgttctaccggcgcggccagcgccgcgctgtccgaagcggacagaacgatcgcgtccgcgccggcgtcaatttcgcgctgcaaaagtgaaatctgttcggcgctgtcgttttccccagacaacgtgatgaagctcaaatcaacattcatttcgctggcggcctgatcggcgccctgccggatggattcccaacggtccccagcgcgcccgcgcacaatgacggaaatccggtaaatttcaggcgggggttccttgccgaaggcgtcgaaagccaacagcaaaaagccgagcgcaaacatgcagaacagcaacaggaaggcgagcgccctgcgctttgtcatacagccccctcctttaacggctgtgcgccgccataaactaactgcggcaggcgcacacggattgttgtgccgacatccggctcgctgatgatcgtcaggccatacggctcgccgtaatacagacggatgcgctggtgcacattgcgaagcccgataccggaccctttggagcgcacccgtgtctcgtcggtcagcagtgtggcgcaaacatccgcgggaataccgcagccattgtcttcgacgtcgatgatcaggtcatcgtccgccagataagcgcgcacgcagatctcaccgtctccgtcggcaaattccatgccgtgatagattgcattttccaaaagcggctggatgatcagcttgatggttgaaagcccaagcgtttccggttgggcatcgacagatacggtgaatttgtttttataacgcatggtctggatggtcaggtaattgcgcgcgtgctcaagctcatctgaaactgatataatcgttttgcccttggacaagctgatccgaaacaggcgcgcaagcgccgtaaccatcgtgacggcttcgggatatcgctcattctcgatcatccagacaatggaatcgagcgtattgtagagaaaatgcggattgatttggctttgcagcgcgtcgaattcgcttttgcgcttcgattcctgctcggccacgatatcgtccatcaggctgcgcatctgcgccaccattgtgcggattgtcttgccaagatgcgccacctcgtaggaaccgccgaccgcgatttccgtatcccaatttccgccctccaatcctttgacggagcgttccaggcgcttgatcgggttggcgatgcgtgaggatataaacagattgacaaagatcatcaaaaagatggtgaacagaatgataaacacagcgaaggtacggatggcgtaggagtcggatacagcgtcctgcatcggcgtgacgccgacaatcttccagccggtgtagccgaccgttttgatggtgacgatccgttcctggccgtcgaaggtttccacatggctgccatcgtcatagctgacagcggcacggttattttcggagagaagattggagtaaagaagctgctggcgtggatggtaaatgatttcaccggcgctgtctacgagatagacgtaaccagatccgcccaggttgacattcttaaaaagctgctcgataccggaataattcatgtcgacaagcaaaacgccgcgcgtcacagcgccatcgcgtgtcagctcgacagcacgcgaaagcgaaacgacccaccggtaattgtatcccggatcgatgaacaggttctgcacatgcggcgtggagaaatgcagattttcaatccggtccatagcccggataaaccattcctgttcaggcgggtcgaccgtcggcttgagcatggagacaggcgccgcgccgacaagcgaaccatccgcctcgaccacaacgatactgacaagcaagtcgcggttcgtctcatagagcaggtccatctgctggtggatcgattcatcagcgaggtcggcgcttttgatcacacggtaatacatcgcgtccgatacacgcatcatattgcgcagatagacatccaggttgatattgacctggtcgatcacacgcttgttttcctcgcggaccatcgcctcggtggaagcggcgaaccgcagatacagtgcaaagccgagaaagagcatcccggccatcgcagcgatcgagaaggaaagcgagatcaagaactggatgctgcgccggcggtaataatttgttgcgcgcgccagccagccgccggccgccttacgcatggacggcgtcccggctgccgcggtattttgtcggcgacatgccgaactgctttttaaagacatagctgaaataatttggttcggtatagccgaccttcagcgaaatctcatatgttttatcctcggtggtggagagcagcttgaccgcttcatccatgcgtacatttgtcagccacgcaacaaagctcatgccggtttcttttttaaacagcgtggaaaaataggcgggagagacatgaagatgatcgcagagcatttcgaccgaaatatcgggatcactgaagtgctccgcaatgaactgcttggcgccttcggcgataccacgcgtcgaattggaacgctcgcggcggattagctcgctgatgcgcaggcacaattcggataaacgcgcctttaattcgtcaagcgagtcgaaggcctccagccgcaggctggcggcaaaatcgggaccaaacacatcggctgtgtcaagctgataagcgcgcgccagacggaccagttcagccgtcagctccatcaaataaagctgatactgcccaattggcagacgcgtttcataaaaacgcccgatgaaccggttgatcgactggcggattgtgtcaggcgctccaagcttaatcgccgaaagcagctcccgcttgtcctgttcgtcgaaggggatctgcgcggcggcgtccggctcgatatcgtctatgtagatagcgcgtcccgtgccgataagcacacggtagtcaagcgcgctgcgcgcgccgtccatgctgtaatgaagatcaaaaagcgtatcgcacacagttcccacgccgacggtcagcgttaactgcaaaaaacggcgcgccaacttgcacacctggtccaggctgctgatgaattccagaacgccgcccgggtcgtcaaatccggcaatcacagcgacagaaccattatacagttcggtaagccccctgaaacgacggccgagcgcctcctccatcaactgcttgacggagaattggagcagctcccgctgacggattggcgcgtcctcgggaatgtccgattcaaatccggccagcgccgctgtgaactgcgtcccgacaagctgcacaccgtaaagagcggcctgttcggcaatctgtccgcgcggaatgcgcccgtcgagcaggccggccacaaactgcccgcgcagcgcgggcaggcttcgctcgtagtacgagcgaagccgctcaatatcacgcttttcagcaaactctgcatcaagctgcccacgcagtttttgcagcacgccggtcagttcagaggcactcacaggcttaaggatgtattcggccgcgccgatctgaatggccttttgcgcgtattcaaaatcgtcaaagcccgaaaagaacaccagcttgacgccagggaagcgttcagtcagatgacgcccgagcgtcagaccgtccataaacggcatcttgatatcggtcatgacaacgtcgggatgcagcgattcggcaagctccagagcttcctggccgttttcggccgagccgacaaaggtaaagccgctgccggtccagtcgattttacgctgaatgccgtcgcggatttccgcttcgtcgtcgacaagcataatgctgtacagaaagacccctccttgtatactgaatcaatttgacatcataacatcgatggtattatagcacttttccacaaaaaagaaaagggctggtttcgtaaaaaccagcccttttgtacgatttatttggttatttcttcctgtactttgccaagtcgattgcaactgcgactgcaatgatgatgcccttgataacctgctgccacatcggggagacattgatgaactgaagcccgtactggatgacggtgaagatcagaacgccggagaggatgccgccgaccttaccgataccgccgttgagggatacgccgccgacgacgcacgcggcgatcgcgtcaagttcataaccgttgccgtagttatttgtagcgccagcggtcctcgcgccctccaggacgcccgcaaagccgtacaggccgccggccaggatgaagatacccatggtggtgcggaacacattgacgccagagacgaccgcagcctcgcggttgccgccgatagcgtagacgtttttgccgaacaccgtcttgttgaggacgaaccagattacgaccagaacgatcagcgcgatcggaacaagaatagagatgccgggaaatttggttccgaacgccttttccgcaaatttaaactggccaagcagcgcgaagtcggggcgcacgccgccgatgggctgcgagttgttgggcggcatatcgaaatagagcgagcatgcgccatagatgatgacctgtgtggccagcgtcgcgatgaacggatgcatatcgtatttcgcgacaagaaaaccgttaagcccgccgaacatcatacaggcgaggatggacagcgcgaccggaagaataatcgggacctgcggcaggtccgggaaaaagcggtttgcataggtggctgtctggagcatggagcaagagatgaccgacgcgaggccgaccatgcgtccggctgaaagatccgtacctgcgatcagcagcgtaaagcagatgccgagcgcgatgatcagcttggtggacgactgtgtcaggatatcgagcacaacgcgcacctgcatgaatttgcgttccttgatacaaataatcacaacgagcacaagcagcgcgaggataatcgcgttgtttgtcaaaaaggtttttgccgttttggaggagatcgtcacatcgccgagggagtcgcggcgcatatactgcgacaaagcataaaacgcgacgatgacgccgatgccgataacgatgactggcagatcgtaaattgccttgatgttagcgattgtcagcacaatgccgagcacgaccagaacagcggccgcaatgaaaaaatagaccgcataggtagcgcgggagatcgtgttgcctttttgcatacctggtacctcactttccgaactcatttcatgaactgcgttgcaagccgcatgacctcaacctggtcgaactgatccttttcaaggaacccggaaaccttgccctcgcacatgaccatgacgcggtccgacatgccgagcagctcgggcatttcggaggaaatcatgatgatgcttttgccagccttgaccagctcaagcataatcgtgtaaatttcatattttgcgcccacgtcgatgccgcgagtcggttcgtccaggatcaggatatccggttcggtgagcagccagcgggcgatcaggaccttctgctgattgccgccggagaggttctgcataagcgcctcaagggaaggcgtctttacattgagctgcttatcagcgtcatatgctgcctgataccgttttttctggttgagaacgccgtgattggcgtagtttttctggcttgcgatcactgtgttgtcgagtacggacaaacagccgaatacgccggtcgcgcggcgctcctccgtgagcagcgcgattttcagtttcttggcgtcgcgcacatttttgacgatggccggtttgccctccttctccacgatgcccgaagcgattgcgcgcagtccgaacaatgcctcgaccagctcggtgcgctgtgcgccgacaagcccgccgatgccgagaatctcgccgcggtgcagatggaagctgacgttctggaatgatttgggcagtggggaacacagatccttcacacgcaggactgtctcgcgcggcggcatcgggaaatcgcgtaccgggaaacggtttgtcatatcgcgtccgaccatgcggttgataatcagatcggtggtcagctcgctggcgggccaagtgccgacatactgtccatcgcgcataatggtcacttcgtcggagatacgcaggatttcctccatcttatgcgagatgtagatgatcgagcggccctcgctgcgaagctggttgatgatcttaaacaggtgttccgtttcattatctgtaagggatgaggtaggctcatccatgataattatcttcgaattatagctgacggcgcgcgcaatctccacaagctggagcgttgatgcagaaagctcgccggcaactgtctcagggttgatgtccaggtcgaccttttcaaacagttccttcgtcatgcggatcatggctttgcggtcgaccgcgatgcctttcattgggaaacggccaagccagatgttttccatgactggcctgaatcggatggggtgcagctcctgatggatcatggagacgcccaaatcgagcgcctgcttggaggtgttgatgatttcacgttttccgtccagaatgatttcgccgctgtcctcatgataaataccgaacaggcatttcatcaatgtggacttgccggcgccgttttcgcccatgagggcgtgcacggtacccggccgcacctttaaggtgacgccgtccaaggcggtgacgcctggaaatgtcttgacaatattgttcatttccagcatatattcgcccatacagtcctcctccttctatcttaaaatcacgcggcaagccgccgcgcgccgcaaaaccggccgcccaaaaaccggtgggaaaaaggcggcggagactgcggaaagcgcctgctgttccgcgttccccgccgcctgcctatttacgcttcaaaaaattttgctcacatgaaatcctgatagttgtcaaccgtcaccttgacgtacggaatccagacatacttgccgtcggtcacttcatagccgatcgtctcggaagtgacttcctggccgtcagcggcgacagcggcgatgttgatggacgccttgccctggttctcgccgtcgttgaggactgtgccgagcagctcgcccttgctcatggactcaagcgccggggccgtcgcgtcgacgccgaccacagggatgaacttttcagcgtcgccggtgttgtagccttcagccttcaaagcctcgatcgcgccgagcgccatgtcgtcgttgttggcaaagacagcctcgatcttgtcagcgccgtgagaagcaaggaacgtcttcatcaggtcggtcgccttgaccttatcccacatggcggtgtcagccgcaagctcctcgacgccgaacgtgccatcgttggtgatggcttcaatgcaatactggctgcgcagcgttgcatcctgatggccaggctcgccctggagcatgacatactggatcttgccgtcgccgttcttgtccgcttccggatgctctttgaagtaatcgaggatgatctcgccggacattgtgccggattcctcagcacgggcgccgacataccaggctttgtcgtacttgttcatatcctcctcggacggctggcggttgaggaacacgatcggcagatcctccgccatggccttgtcaatgatcgggccagcagcggtcaggtcaaccgggttgacggccagcgcggtgacgcccttggtgatataggtgtcgacctggtcgttctgtgtggcctgcttgttctgcgagtccacgatttccggagccggaatgcccagttcctcggccgcaagcagcatgttgttgcgcacgccggtcataaacgtatcgtcgaatttgtagatgcagacaccgatgctcacatcgtcgggagcgttgatcttaacgccggtagcctcgccggaaggcgtagaagcagcaggcgcagattcggccggagcggacgccgcaggggtgctttcagccggcgccggggtggattcggccggtgtcgaggttgtgccgccgctgcttccgcaggctgccagcgacatgaccatcaaagatgcaaatgcaagagacagaactttcttcatcatttcattcctcctaagtcttgtgtgcgttttgtgaacaatctgtaaaatgatttccttatggtgttcactgtctttattataatttggagcaaagcgcgttactatcaaatattctttcctgtttcattgaatatcttcacatctaaacctgattgcacgaactttccgaataatatttatgcaaaatgccaattaaacaggaaaaataatacgcgccaaaaaagctttgcatccgctaacctgtgcgctgcacatggaacgtctggggctgtttctaaaatcgaaatttccattttttctgtaaacagcagcggatgccgtgttaaaaagctcagaatccgaagggatgcctgcttttgccttgccttctcctgttgcctgcggacaatcctgcaattcctatattattaaacggcccctggagagcttgacaaaaagagaaaagaggatataatttgaaattgagtttcaatttcaaattatatcctcggagggaccgtatggaggttgaatataaaacacggcagcgtgcactgattctgcaatttctttcagacaaccgcgaacgccatctttcggtggacgaggtctttgactacctgcgtgcacagcagtcgcccgttggcaaatcgacggtgtaccgctgccttgaccggctcgtaagccagggccgcgcgcgccgctattttctgggggacggcgcgcgtgcgtgttaccagtatgtagacgggcagggcgcctgccgcgagcatttccatttaaaatgcattggctgcggacagcttttccatgtatcatgcgagcgcctggacgagattgccgcacatgtgctggagcaccacggatttcaggttgaccatacaaaaaccgtattgtatgggctttgcgccggctgcgccgccaaacggaaggaaacggagggacgacagtgaccggttttttaaagcgggcggccgctttgctgtgtgcggccgttctgctggcaggctgcggagcacagccgctgccgcctgaaaatgaacggattgaggtcgtggcgacgctgttcccgcaatatgattttgcgcggcagatcgcgggggctcgcgctgatgtgacgctgcttttgccgcccggcgttgaaagccacgcttatgagccgacgcccgccgatatcatccgcatcaatcaggccgatgtgtttctctatacgggcgcgtatatggagccgtgggcgcaaaagctgatagaagggcttgacggcgatgtgcaggttgtcgatgtgtcggcgcatgtgccgcttgaggaggaatcccatgaccacgagggtcatgatcatgacggtcacggcggctttgatccgcatatctggaccaacccacagaatgcgaaggtgatggtggataatattgctgcagcgctgtccgcagccgatccggctggctcgggactgtttatgacaaacgcagccgattataaggcgcagctcgatgagcttgacgagacgatcatggagattgtcgggatgtcggagcatcgcgagattgtgtttggcggacggtttgccatgcgctatttcgctgaacattatggacttgcctggtcggcggctttcgattcctgttcgggagaaacggagccgagcgtgcgggctgtggcgcagatcgtcgacaacatccaaaaaaaccgcatccctgtgatctattatgaggagctaaccgatcccaaggttgcgcgcgccattgcgcgcgagtccggcgcgcagccgctgttgctccactcgtgccacaatgtgtcaaaggacgaacttgcggcgggtgcgacatacctgtccctgatggaacagaatgcggtaaatttgaaaagggggctgaatggatggcgctgatttcctgccggcatgtgaccatgcgttatgaaaaccgggtggccgtcgacgacgtcagctttgatattgcgccgggtgattatgtgtgcattgtcggcgaaaacggatcgggaaagagtacgctgctcaaagggctgcttggcctgaaagcgccgcgctccggtgaaatcgtctatggggatggactgcgccaaaatatgatcggctatctgccgcagcagacggttgtacagcgcgattttcccgcgtccgtctgggaggtggtgctctccggctgtctgaaccggcgcggcctgcgtcccttctacacccctgccgaacggcggattgcgcgcgcaaatatcgaaaagctggggatcggcgcgctggtcaaaaaatcgtaccgcgcgctttccggcggacagcaacagcgcgtactgctggcgcgggcgctgtgtgcgacggaaaaactgcttctgctcgacgagccggtgacagggcttgatccggttgtcacagcggagctgtacgcgttgatccgccatcttaacgaggagggcgtgaccattgtcatggtcagccacgatatcaattgttcggtgcataacgccggaaaaattttgcatatggatacgcgcgtgctgttttatggtgcagccgacgactatgccaaaagcgagctttgccgcaaatttatcggaggtgacggtcatgcttgatctgctgcgcgacctgttttcctattcgtttatgctgcgtgccgtcatcgtgggagtccttgtttcgctgtgcgccgcactgcttggcgtaagcttggtgctcaagcggtattccatgattggagacggcctgtcgcatgtcggttttggcgctctgtcggttgctgtggcggctggcgccgctcctctggcggtatcggtcccggtcgtggttgcagcggcgtttttgttgctgcggatcagcgagtcgagcgccatccgcggagattcggcgatcgcattgatttcgtcagcctccctggcagccggggtcatcgtcacatctctgacaaccggaatgaatgtcgacgtgtatggctatttgttcggaagcatcctcgctatgagcgagggggatgtgctcctgagcattgtgctgtctgtgattgtgatctgcctgtttgttctgttttacaacaagatttttgcaatcacattcgatgaatcgttcgcgcgtgcgaccggcacgaatacacgtttttacagtatgctgatcgcgctgctgacagcgttgacaattgtggttggaatgcgtgtgatgggggcgatgctcatctccagcctgattatttttcccgctttgacatccatgcgcgtctgccgcagcttccgcggtgtggtgctggtttcggcggttgtttccgttgtgtgcttcttttttggaatgctcgcgtcgtttgtgtggtccacgcctgctggcgcgtcagtcgtcgctgtcaatgtcgtggccttcggattgttcggccttttcagccttttttcccgcttttttgaaaaaaagcttggtaaaaaactttagtcggctgcgccgcgaacagcgggtcaggcgctgtgtacaaaagctggccctgccgtgcgcccgcccatatgaagggaatggctgaaataaaatgcagacagggggctgtgcaatcagcgcagccccctgtctgcattttacctgaatatttgtggttgccaaaaaagcgtgctcttaaatggagagggcagatctttggacgcaaacggactgcttgatcgtaaattggccaacgagctgtgtgagtacctgtgcctggcttgcaagctgttcggcggctgcggcgctctcctcggaggtcgccgagttcgtctgcacgacagcggaaatctgcgatatgctgtctgtgataccggcaattgcctcagcctggtcggcggacaaatctgaaattgtcttaatcttctcagcgacagcccgcgcgccctccacgatgctgccaagcgactgctgtgtcgaatctgtcaaattgacgccattggtaacagccatgagcgaccgctcgatcaaagcggtggtgttgctggctgcttcggcgctcttggcggcaaggttgcgcacctcatccgcgacgacggcgaagcccttgccggctacgccggcacgcgcagcctccacggccgcgttgagagcaaggatatttgtctggaatgcaatatcgtcgattgttttgataatgttgccgatttcctgtgagctttcactgatctcgtacatggcctgcgccatttcgctcatctgctgattacagctttcaatctggctgcccacatcgattgtaatatcacgggttgccacagcttcttgtgcgttgctgttgatctgccgggaaatgtcgttgaccctggcaaccagatggtcaagctctgaggactgttccgtggacccctgcgccaaagtctgcgcgccaatggacacctgttgcgactcgtttgtaacttcgccggcggaacgctgaatctgacacattgtttcattcaaatgtttcagaataacttcgatggaatgctcaatggcggtaaattcgccgatatattccacagtattttcacgtgtcaggttgccgtttgcaatttcgcccagatgttctgatatatcggtgatatagtgcttgagcgttgccacggatgaattcaggctctgagccaaaacgccgatttcattcttgctgtggatgtcgatccggaagcttaaatctccctgtgaaagtttacggctggattctgtaatttcaacaatgggatacacaattttacggatgatatagcgcaccagcagatagcatacgaccacaatcaaaaggattgtcaggacagaaataatctgtgtgatgagaatggcttggtcaagctgctgctcattataggcgagcaggctttctgagatggagataacttcatccaatttggaaacaagggcgctgacattgacctttgtctcgtttaaaaacattttggatgcagtctgagggttggttttattcatttctagaatggtttccgccgaatcatggatactctgatgaatcggctttatttcttctatcagcgttatgatccgggcatccggaattgtcgccgtatcggtattgtacagccagttcccgagtgaacaggacgtgtaatccatgctgccggtaaactcggtatcaaaattgatcgccgaactgagattttccacccaactgaaatgcgctttttccgcgtcaagcgccatgatatagagatcggtggcctgagtggtagaggcattatatcgattgattgcagtcaatccgccgattgtactgaccccgctgataaccagtgcgaaaaagatcacagcaacacgcagccaaacggcttttttaatcgagtttttcaaaacataaacgcctcttttcagttagttttaaaaccatatttttgaatatgtaatataatcatacttgaaaatatgacattttgcaactaaatgtgttgaaatttgtgaaaaattaaacacaaaatatttataaataatttcgctccgatctatgaaaaaataccatagctttattttagctgcttatttggctgcatcaaaacgcccttgtcaagccatcgataaagtgtgcgcctgctgacgccgagcgcggcgccggcctgcgctgcggtaatccggtgcgcgcgccattcctgaatgatctgtgcccgggtgcggtcgcccgccagaaattttgagggcctgccaaatttgacgccgcgtagccgcgcggcccggatcccttcggattgacgttgatgaatgttttcgcgttcgttttgcgccacaaaggaaagcagctgcaataccaaatccgaaattagtgtatcgagcagatcacgccggccgcgcgtgtcaagcagaggcatgtccagcactacgatatcgatcatcagcttatgcgtcaggtgatgccattgctccaggatttcctgataattgcgtcccaggcggtccaggctgcatatgacaagcaaatcaccctttcgcaattttttcaccagacgcatataggccgggcgctcaaaatggctgccgctttgcttatccacaaagatattctcaggcagaatttcaaatcggctgttgagggacagcatttgacggtcctcatattgacttctggtcgatacccttgcatacccatagatggtctggctcatatgtttctgtcaatcctttcttttatcgtccaaagccgcaccccggcctttgctgccttccatccggctatccctgccgtgtctgtttccttttaccccgcttttgtctgtgatttataaatttgttagatctatccaactgggcttattttactgaacataaaatttattatatcacaatttatttccttgtaaatcagtattatatatttagaaatgtaaattttacaatttatattatgtgcttatttcatatatactgctgcggtaaaagatgcccccagcgggatacatacgcaatgtttgactatatgctgttttagacaacagaaaaccaccgaagcaaacaccccggtggtttttcttttaagaacggctgcccggtttgactgtttcatgcgaatcctttttacatacctcctccaacaatgtatatacagcacattgaacttcgggtggcgcacgatcaaacgcctcctgataatccgtcaagactggctgctgatcacatatctgctttttctttgcgttttcggcgcaacggcatgtgttcaacaacaacatacacgggtctattgccaaggcttttgcgattcgttccaggactgtgatcgttggattctcttttcccagctccatcttactgatataagatgagctggtttgtgctcgaaaggccagttcctcctgtgtgaagcctcgcgcttcccgccagaatcgaatgttctttcccagcatgcggtgtagcttcatagacatcacctcttgcttgagcatacaggaatcggcgtatatttaccatattggatagaaccagtagccaattgaaggaaatgggaaattattcctgattataacacccgtggaaagagatatatgtctgtgccctgcatcttgagaaagcaccgcgattatggtaaaataagcgcaaggcgcttattttaccttcatggccagggcgatacgcgtgcgcggcccgctgccgccctggtggccaattttaccatgccgcttcgcggacatggtaaaataagcgcaaggcgcttattttaccttcatggctagggcgatacgcgtgcgcagcccgctgccgccctgatggccaattttaccatgccgcttcgcgaacatggtaaaataagcgcaaggcgcttattttaccttcatggccaaggcgatacgcgtgcgcagcccgctgccgccctgatggccaattttacttgtgggggatgcagcgcagctttggtcgagtgttccgactggagatatcccatccacacagcgccataacatcagaaaataaacacagcccgcgcttgccggcattggagtcaatcaatagaaagccggtatttggggaacgatatccataagcgcggcgttgccagaatgcagaggaagttgtatgaacattcatgaatccgctgaaaattatcttgaggctattttaattttaaaaaatgaacgcggtgctgtgcgttccattgatattgcacagcatatgcagttttccaagccaagtgtcagccgcgcaatgagccttttgcgcggtgacggctatatcactgtcgattcggacggctttatcgagctggcagaatccggtcttgcgattgcggagcgcatctatgagcgccatcggttgatgacagattggcttgtgcgcattggcgtatcgcccgatacggcggcgcaggatgcatgcaagatcgagcatgatatcagtgaggaaacatttaagaagctgaaagaacatattaacgaacatattcacgaggcgaagtccgaagcgtagcagcggcgcctgttaaggggcttttcttttctgccgtgcgatgataaaatagggtaagttacctagcactaactttaatgaggacgcgacaggccgctgctactatacaaaatgctgcgaggtcataggcagttttaaggaccggccttacgggaatcaggtcgtctttgtatgtgagtcggacactgtgggcagcggactcaagggtgaaaaatgtcttatcaaccatttgcttcgcgtggtaagacaactgcgacctgcggacattttatgccggcgcgaagcggcggaacaggggaatggaatgagtgtaatgcatcccgctctttcggctttggccgggacaggctttacttgtctgatgacagctctcggcgccgcaatggtattcttttttcgcggtgaagtcaaggctgcgtttcaacaggcttttcttggctttgccgcgggtgtaatgattgcggcgtctgtctggtcgctgctcatgccggcgattgagatggccgaggagcgcggcacgcccggctggcttccggctgccggggggttcttgatcggcgcggtttttttgcagtcgctcgaccggctgctgccccatttgcatcccggcagtgaccagccggaggggcttccggcccgtttgcggcgcaccacaatgcttgtgtttgccgttacgctgcacaatctgcccgagggaatggctgtcggcctttccttcgcgcttgcggctcaggacggtgaagcgtctacgcttgcgggcgcgctcgcattggcgatcggaatcggtctgcaaaactttccggaaggcgcggctatctctttgccgttgcgtcaggaagggcttacacgcacacgcagctttgtctatggcgcgctttcaggggttgtcgagccgatcggcggtgtcctgaccgtttttctggcaggctccatcgcaccgctgatgccatggctgcttgcgtttgcggcgggcgcgatgatctatgttgttgtcgaggaattgatccccgaggcacagcttggcgagcattcgcacgttggcacagccggcgtgctgattggatttgtggtaatgatggtattggatgttgcgcttggctgaatgtattttgattttaatttattggaaagaggctggtacttgatcatgttggagcttcggcagatcagcgttgacgtagatggcaatcatgaaattctgcgcggcatcaatctgacaattggcgacggtcgttttgttgcgatcacaggaccgaacggcggtggtaaatcgacattggcgcgcgtgatcgcggggattaccgcgcccatatccggcacgctgctgcttgatggacaggatatcacacagaaatcgattaccgaccgcgcacagcttggtattggatttgcctttcagcagcctgtgcgctttaaggggttaacggtacgcgatcttgtggagcttgccgcggggggaaggctgagtgagcagcagctctgcgcggcgctcagcgatgtggggctttgtgcgagggactatgtagaccgtgaggtgaacgcgagcttatccggcggcgaaatcaagcgcattgaaattgcaatggttatgatgcgcggcgcacgcctatccatttttgacgaaccagaggcaggcatcgatctgtggagctttcaaaatctgatcgatgtatttcaaaagctgcgcgcgcagacgaagggatcgattgtcgtcatctcccatcaggagcggatccttgagattgcggacgaaatcatcgtgcttgccgacggcaaggttgtccgccaaggcccgcgcgatgaaattctgtccggtctggtctgcggcggcggacgctgtgcgttttgtacaaaggaggccggatgccatgaataagattacacagatgcttatggaaattgtgtcggagctttccggcaaaccagccggcgcttataatatccgggaggatgggcagtgtgccggccgtcaatcgaccgatcatatccgcattacgccgaaaacaagcgaaccaggtatcgatatccgggtactgccaggaacaatgggggaatctgtctatattccggcttgtatcacacatgccggtgtgaatgaccttgtttacaacgatttttatatcggagatggagccgatgtgacgattgtggccggatgcggcgttcatagcgatggggaggaggaagcgcggcacaacggcatccaccgttttttcattggtaaaggcgcgcatgtgctttacctggaaaagcatgttggaacaggcgatggaaccggcaaacggatcatcaatccacagacgcaggtacaaatcgcggaaggcggttacatgaaaatggatacaacacagatcaagggcgtcgattcaacaaagcgcgtgacaacggcgtcgctggggccgcgcgcacggcttgtaatccgggaaaagctcatgacgcatggcgtacagatggctgaatctgattttacagtcgatctcgacggagaggacgcaggcgtagatctcgtgtcgcgttcggtcgcgcgcgggcagtcgcatcaggtgttccgttcgcgtatcaatggaaacacacgctgcacaggtcattcggaatgtgatgcgatcattatggatgaaggtgttgtaagcgccattccagagctgacggctgcgaatatagacgcatcgctcatccatgaggccgccattggcaagatcgccggagaacagcttgttaagctgatgacgcttggactgactgaggaggaagctgaggccaagatcatcgaggggtttttgaaatgatggaacctgttgcaggcgcggttattacaacgccgcgcctgtttttgcgcatattggagcaagcggacttgccggcgatgaaacgtgttttacaggatgaacagacgatgtacgcctatgagcatgcattcgacgaccaggaggcgcaggaatggcttgaccggcagcgcgcgcggtatgtggaatatggttttgggctgtggggcgtttttttgcgcgcttcgggccgaatgatcggtcagtgcggcgttacgatgcaggattgcggcggcgcctgtgtgccggagatcggatatctgctggagcgcgtccattggcattgcggctatgctgcagaggctgcatgcgcgtgccgcaattatgcgtttgatgcgctcggctttgacgaggttttttcaataatccgtgacacaaattttgcttctcagcgtgtggcgcgccgcatgggtatgaatccgcgcggaatgatcgtgaagcgctactatggcattgatatgccgcatatctgtttttctgtacgaagaacatagtgcgaccatacgatgggagatgtaaagtgcgcttcatgaaaaattttaccgtgtggatgcaacaattgtttacagaaaccgcactgtttaagcagacaggctgaggattgtttgaaaataatagaaatgcctttgcttttaaacaagccataagcagccggtcaaaagggagggaatcggccgatgaattgtaaaataatttctgcggcggcttttgcggcgttgctgcttcttgtgggatgcgcttcggacgcatcggatgcggacacatcggcaacatcatcttatatcgaattagcgctgctttccgactcgtccgatcacagcccggacatgggggaaaccgccgaacagcttgcctcgcgtctgcttgcttcgggcgagcttggacaggccgtgttccactggcgcggcggcggcgcccggtatgaggctgatttgggcgaagatggagagctgaccctgtatgaatacacagatgcggctgaagcggcggaacaggccagccaatttatatcggatatgcatggatcggaacttcgtacattttactgtgatggtaacttgattgcgtcttatgaagggacgaacgcgcgtgtttataagcttttggaggatgtgctcggtcctgcactggcgcgctgattataatttgaacagccccgcggcaagtctgagactgccgtggggctgttttataggggcgttttttgcatcaaaagacaaaaggacaaatttggttagggcctgtttgaaaatagaggaattgccaagtttttcgcagactgcaggaaaatacaaggcaaaaaagcaggaatccttccggattccgaagctttttaatgcggcattcgccgctgtttgcagaaaaagacagcgattttgattttttaacagcccctgggggcagatgtatctttcctatttatttacagtacaggcagcgtcttcagagcctcagaaccggctggcttgtgaggctctataaatgtccgtaatccataaaaatccccgtcggttgtggaggcaaccgacggggattttattcagaaagaatccaaatcagaatggattatttcgctttgcggaaagcaacagcgccggcaacggccagagagaggacgccagccataacggccacgttcaccatgtcgctggaaccggtgttcgggatgtttttgtccggagtagaggtggtcggggcgtcgccgccgttaccagtctcgccgggatcgacatgagagttgtcgacatcaagctcggtgtcagagacaatgtaggtgccgagcgtacgggtctggatggaccagccagggatctcgcgagcatcttcgctgtaggtgaacttgttggtcacatcgacgagatagccgtcagcgtcaagctcgtagatgtagcaagcttccggatccggggtgtaatcgtcgttgtcatcccacggaatacccagggtcagccaagcgcgggaagtggacgggattgtggagctgccgacaaagtcatagaaccacagatccgcatcggcaggatcgccgtactcggtgtagatgtcgcccatggacttcgtggagagcttcgcatagaacttggaagcgtcgtcatcggactcgaactcgagcgccgcacgatcatcgccccagatgagcgtgttcgtgtcgtttgcatccggatccatcacgatgccgtcgcccgtatccgggttgtcatcgttaccgacggtctcgttggaaacccacatggtgtacttgatagacagggtatcgttcttggaccaatcgaacttggtagagccagaactctgaccgtagctacgcggctgatccttcttgttctgatagtccttgaggttgttcttggccttgaattcaatcgtaccggtcgtcttgttctcatcggtcgcggtcgtgtcggccacttcgatcttcagataagcggcacggtcaaaattgccgagcttcttgtcatcgacaacggtgatgctcttaacgagcttgccgttaacatccttgtcaacatcgaacttgaagtaatcggtgtccgtgatgtcctcacagtaagcgaagaaaccaccgctggcggaaagcgtatcattcatgccctgatacagcgggacgtagatcgtggaaccagggcgaaccggatcaatcgacagggacgaggaagccagaccgttccaactgccaagaccattcgggacgtcattagttacttctccgtcgctgtcatacgcgtccttcatcggaacagcagcagcgaacacggagactgcgctcatgctcaggacagtagcgccagcgagcatcgcgcaaagaacctttttcatgttcattgcaaatatcctccttgcaaaaatcagtttctaaaattggcttgttgcgggcggtcctccaaccaatcccttaactgttaccaattatagcgtggggaaaaggaaatgtcaagtgtttttgtaaccagtttgtaactttttctttttattttgttaccgctttgtcattagttttacaaatattggaataattaaaggcgaattggaacaaaaaggaatattagtcattaattttcacactggggcggctgcatattcagcaggcggcgcagcattgcatagtagacgggaatcaacagcgcggtcgcgccgatccatgccatcggggtggaaaaacagatgcccgggtacccccagaaacgcgacaaaagcaatgcgcagacaacacgcagaacaagctcgatcacacaagcaaggaagggcgctttcggattgcccatgctctgcacagccgttcgatagcacagcagcgcgccgagcaccggatagaatgggatgaccaccagaaaataggtgcgcgcgaaggaaaggatttcgagtcccgggctgtcgacaaacagcgggacgatgaccggctcaatcagaaggatcaacgcgcccatcagcaggttggcgcattccgtcatgagaaagcaggcgttgaagccgcgcttgatgcggtcgattttgcccgcgccgtaattttgcgccacataagtcgaaagcgtcacgccaaaagcgttgttgacgagcacggacatctgatcgacctttgtggcggccgtgtaacctgcgaccgcgtttgtcccgatggcgttgacggcggcctgcatcgccatctggccgatgcacataaccgacatctggaatcccatcgggaacccgatcttcaagtgctggagcaccaggaacctgtcaaggttccagtcggaacgcttcagccgcatcgcgtcgaaccgctgtacagcataggcggcgcagaacacagccgccaaaagctgcgaaagattggtcgcccatgcagcgccgccgacccccatatcaagcgggacgatgaatacaatatcgagtacgatatttaataaggaagaaaagacaagaaaatagaggggggtacggctgtccccgagcgcgcgcaggatgttggaaatcagattgtaaaaaatagtcgtaaaggcgccgtagaaaatgacgatcatgtaatcataagccaattcgaaaatatcgcccggcgtatccataaccgccagcaccggccgcgccaggatacagataacggctgtgatcacaatggaaaaaaacagcgacagcagtgtggaaatgccgacacagcgccggacattcttttcatcgcctgcgccgaaatactgcgccagcaggattgcaaagccactggtcagcccctgtacaaagcagaggataaaatagatgattgtacctgtcgcgcccactgcggccagcgcctcgggtccaagcgtgcgcccaacgataaccgtatcggccagcgtataaaaaagctgaaacaagttgccaaggatgacagggatggaaaatttaaacagaagcggagcgggcgcgccgcaggtcagatcctttgtcatgtgcagatcaactcccttgcaggatgattcggaagatgcgtcatacatccgctagaaacaagagaaacaatagcacaatcacatgcttcttgcaagatcggttttgcgatttttcacaatttcatgaatatgtatgaattcctgcaaccaggagcggattcttttgatacggcaaacaaaaagccccgggccgcagcagggcccgggacagatcgctttgaccgctcaaaggccaaacagttcagcggccagacggcgcccggtgggagtcgccgcaagcccgccttcgcttgtttcacgcagcgcggcgggcatcgcgtcgccgatgcgcttcatggcgatgatgacctcgtcggcaggaatggcgctcgcgacgccggcaagcgccagctcggcggcggtgaaggcgttggcgatgccggacgcattgcgtttgatgcaggggatttccaccagtcctgcgacggggtcgcagacaagcccaagcacatttttcagcgcgatggcgacagcgtgcgaggccatttggggagagcctcccgccaactccacaagcgcggcggccgccattgctgaggcggagccgcactccgcctggcagccgccctgcgccccggccagacacgcgttgttggcgatgaccatcccgacggcggacgctgtgaacagactcattacacagttatgccgcgccacgccccggtcgtgcagcatggtcaggacagcggcgggcaggatcccgcaggagccggctgtcggcgcggctacaatgcgtcccatcgcggcattcagctctgaaacggcgagcgcgcgcgccagcgcgcgcgtaaaaacgccgccacagagcgtattaccgctgtcagcggcaatacgcagcaaataggcgctgccgccggtcagcccgcttgtggaacgcagatcgggctgcacaccttcgtcggccgcttcatccatcacagtgagccggcggtccatctcctgaaaaagcagctttggatcccgttccatttgtttcgcctgatcagccagcacaagctctgaaatctggcggccgctttctgtcgccgcgcggacaaggcccgcgaggctgttgtatcgcagttccattcaaaattcctcccaaagcggctcatacaggctcgaggcgtgtggagccaatgatgttgggcaatgcgcggatcttttcattgagcgtgcggtcgatgctcccatccgtttcaatggtcatcacggccgtaccgcccttctgctcgcgcgccagcctgaaattgcagatattgacgccataactgcccaagcattccgtcacagccgcgatggtgccaggcgcgtcgcggtgcaatacaatcagcgtggcatactgtccggtgatctccaccgccattccattgacctttgtgatcaggatgctcccgccgccgattgacgcgccctggacgctgacacagcgtccatccgccgctgtcagtgtgaccagagcggtgttgggatgcgcgccctcgatatggtcgggaataattgtgaccgcaagcccggattgcattgcaagcacggggctgtcacgcaggcgggcatcgtccggcttcattccaaggatgcccgcaatcagcgccttatcggtgccatgtccgcggtatgttctggcaaacgaaccatgcaggcgtatttctgccttcacagccggtgcgcccagcagcgcgccggccatcctgccgatccgtgctgcgcccgctgtgtgggagcttgatggaccaatcatgaccggcccgatgatatcaaatacattcatgcgtgttctggcctccctgttttgtagtttgcaccgccggctcccaaattttctaaaaaaagagatgcgccgtgcggagcatctcctgttcatcttatatttgcctgcctctcccggccgtcaatagtcaattacgacaaaggggccgagattcgcggtgcaatcgagcggctgcgaaaagtcggcgggataaaaactgccataatgcggacgagttgggtgctcgcagagcttgtaaaaattcccgaaaaaagcggcgtccttatgcgggacaaaatccccggcatatacggccggttccacacggatatttccgccccaatagaccccctgcaaatcctcgccctggaagggatgcacaaaggcccggctgctgtccgacagatcggcttcgccgcgccgcgccccaaaaacgccgtcggcgcgcagcgaaataatcagcggcggcgcgccgggggtgagcgcgagaacaacgcgcacttcgctttgcggcagcggcttcgactcgaacgaaaggagttggacatgcagtccgtctgcagcaaaacagatgcgcgcctgcgcatagggcttatagtcgcgcggttcaagcgggtattcgcgcagcttggcaacatgcagggtttcaaaatcaggcgcgcccaaaaacaggcggactttaaaggacatggcccgcacctcctgtaagcagttttgtcacagcgccggataggcgccgtccggatgataaatgatgtaactgccgacattgttgctggcagccgcgccaatctgcgcttttatatcttccgcagtgtacattttattattcgtcagcgtatagtcagctggatacgcctggaccatggcggtgacctgtttgcccgacagatcaggcgcaatgaatttgagcagggaatcgactgtgccgcccggatcaagcacgggcgcatcaagcgtaaagctttccagcgtgaaggcgtcgccgaactgggcgggcatcacaccgatcgtgacattttcgttcgcaagcgcaagcgggttggaaccataataggtattgtttgcgccaagcgcagccagccctgtaatgtatacgctgacttcacccccgagcgcctcaacgcgcgcgtcggccgcgtcgataaattcagccagcgcgtcggaacgcgtcttgccggatgcgttcgggccatatgttgcaagctcgagtccgtagccggtggggaagctcacattatccagcatcacacggcgaacgcccattgatacgctctcggcagcgatgtctgtaatataggcctgcgcaagctcggagtaagggttgagccatggcttgccgcccgattcgggtgcattatcaagccaggtggtgtcggtattcatatattttacacacgcctcggggatgcggttggccgcggttggatcgcgaaaggcgtttagccggccgatcggtacgaggtttttttccgccagcttttcacagagccgcccgagatcgtagggattctgggcctgtgcctcggcctgggcgaccaattcaagctgcgagcggtaaagcacggttccatttgtgtccttcagatcgaacaaaacagcgtttgtatccgtgcgcgaaagctcgtcgagcatactatccagccgcgtctcatcgagcaggatggaaaccggcagataaacggcgtgcagctccgccggaagcgcgggcgcggcgggctgctccggctccgcaggcgcctggctgctgcttacgggcgcgctttcctccggtgcgcccgacggcgatccatcatccgtagccagaagcgtgccggcaaaatagtcgcggatcggtccataagcgttccagccgatgaaagcgaacgccgccacaacggcgatcgttgctgcccagcgcagcagccgcgcgcgcaacggccgctttccccggtaaatatggttgtaacgctttattttgtaatttttttccatcgtttcaccaccatctttcacgccgctgcacacggcgggtacatgcagggaagccccctttggcgcctttaagaatccgtattcacagccgccaggtgccgtccaggcgggtcttttgccccgtttcgtgttgaattttcctgccgggcggcagcccgcctgcgaaaatttgccttgaccgggtacaaaacccttcgcctgtccgccatcctccggccatggatacaagttctgagacaggctctcattacaggctgggaacagatttttatgttggaagctgatggccgattaagccgtagattgcaagcgaaaggataccaatatatataagcgcaacaggcagcccgcggaaagcccgcggaacatctgaaagcgcgatgcgtttgcgtccctcgctgatcagcagcagggcaagcgtgtaccccgcgcccgaaccaaaggcaaagccgcaggttttcagataaccatatccgcttgaaaaagccagcaggattgcgccgagcacagcggtattaagcgccgccgggagcgcgagcggccgcagcgcatagtgcagacgcggcagccaggcacgtgtaactgcataggtcagggcgaatacaaggcagatgcacagcagcgttgtaatgcttgaaaggtagcggattccaagccgtgaggacaggcggtaaaggcgcagcagatagttaagcggccacgccagcgccgcggacagcgttacaatgtatatcagaaacgcgccgaaccgcagaatcccgcgcggcttgttcagcgcgagcgtttcgccgctcgcgccgaggccgcgggcaaagacggcgttttgcaatatggccgcggtaaaggcggcgattaaaaattcggagatataagtcatcatgttcctcccatggagcagggcttgttttcaaaaggagactgacaggccgcagcgaaaaggcgggcggcgcagcgcggcggattatgcggatggcggcgcggtgcgcggattatcgcggcgatagatcaaaagcagcgccgcgcgccggagaaaacgcgccgccgcactgagcagagccagaaggataaagccggtaaaagtgatttggatgccgctcagggtaaacggagcgcgcaccggcacgccccagatattgcctgtaccaagccattcgcgcagcagcgcaagaaggcacataatcagcgcaaagccggcgctgtaggaaacggcgtccacaagcgcgaacacgggctttcggcggctgtcggcgtagcggccacagagcgtcagcagcagcgtattgaccgacaaaagcggtacaaaaatgccaagcgaatcggcgacctccggcgagatcggcaggatcagaggcacgcaggcaacaataagcgcgagggaaaacagcgtataaagaatcggcgcgccccaccgcggcaggcgcgcgccggccagcgatgcgagcagaaccgtcgggacgagcgaacaggccagcagaatcgaaatggagacgctgtttttaaggctggtggtgatcacaaccgcaaatggtatcgccatcccgccgacaagcacggggttgtgcgtcagcaggccgtcaaaccaacggctgcgttttcgcaccgcccttactctttctagcttcaagatgcttcctccttaccatccggtgcagggattcattatagcggtcaatcagggagacaaacgcatttgacaacaaaatagcaaacgacatgctctcctcataaccgccgacatagcggaacagcatagttatcgctccggcaaaaacgccgtaaacggccagcgaagtatcccgcttgggacttgtgaccgggtctgtgatgcagaacacggcgccgaacagcatagcgccggacatcaattcatagatgacggactgtatcccatcgcccgcgacgcgcgggaataaaaacgcgatcagcgcgcaggtggccaaaaacgggaccgggagctgccagcgcacagtgcgccggaacagaagatatccaaggcacgcggccacgaccagaatattggtcgcgcccatcggtccgggataattgcccagcagcatggaagtgatgtcgtttgaagggatgccgccaagtttgattacaaacgccggattctgatagagcgtagtcgtgacatcgccgaaaagcggcagacggtcaaagggcatgggatacatgaacaccagcccaggccagcagatcgccgcgaaagaaaagccggcggccgcggggttgaacagattgtgtcctgtcccgccgaagggatgcttaacgattgcaatcgcaaagaccgacgcagcggccggcacataatacggcacggacgcaggcatcatcattgcgatgatcagtcccgtgacaatgggggacagatcgcgcgggttcggcgcccggccgcgcagcagcgtgcacgctgcatccgcgatgacagccgggatgacagcggccgcgcagaccatcagcgcgcgcggtccataatatagaaatccaagtgcgcacagcacaagcagcagtaagatgacatcgctcatcagggtgcggctgctctcctgatggcggatgtggggcgcggcccttcgattcagtttcaacggtcgtcctccccctttttggcagacggttcgtcattttttcgccatccatgccgtccgctggcggcaagcgcaggctcatccacgctgtccgcgtgcgcaaaagcttctttctcagacgcgccggcctgctccgccacggcggctggcgccagatcgccggacgcctgttcataggtcaaggcaggcgccgcggtatcgtccggactgccggccgccgtatcgactgtcagcggcggcgggggcatagcctcgcggaacaggctgtcgatgtcgagatcgaggcgcggcccgctatccgttcgttcaggctccatctgctcaggtgcgggtgactcgatcggggcctgcgtctgggccgcctgtgcaggagccgccccggcaggctcgtccgggctgtccgcgaaagcgtccttttcggacgcgccgctgtccggggacgcctgcggcgggtcttgccgcattgccggggccgaaacagcgcgcccggtgacggccgcgcgcgcggcctccatctcgctgcggtaagcgcgcgcctcggagcgcgcgtcctcaagcgcccgctcaatcttttcacggatatcgcgatcgttgtcggcaatcgccttttgccgcgcgtcatagtccgcctgcgcctgcgtaagcgcctcagcatgggcggcctgcgccgcctcatatacggcctgcgcttcagcgcgccccagggcggcggctctttcagcttcctggtaagcggcagtcagctgcgcgcgaacctgcttgtcgtgctcctgcgccgcttccagcgcggcgagcgcctgtgccttagctgtacggttttgctcccgcgctgcttcaaagacaccctgcgcgtccagcttttcctgccggtttttagcttgcgctgactcgtatgccgcatccgctttgatcttggcggcgcggttctgttcctgcgcgccttcaagtccggcctgcgcctgtatctttgcgctgcggttccgcttctgcgcttcctcataaagccgcgctgcgcgttcctttgcctgtccggcggcatcctccgcctgcttgagtgcgctggctgccgcttgtctggcggcgtcgcgcgttttctgcgcgctctcccggcggccgggaccggctgccttgacgctcttgagcgcgttttgtgcggatgcgcgcgcttcttcggtcgcgccgctttgcttcatgacgcggtcgagcgccttttgcgcgtcgcgctcggcggtttcgtgtgccttcagcgcggattcaaacgtcttatcagcctcgcgcagagcggcgtccttggccttgcgcgcgtgttcgacagagcggtcggcctccttttcagcatcctgcctggcgcgcagcgccgccgccaatgtctgatcggccgttttttcggaggcttgccgtgcgttttgagctgcgtcaagcgcacggtcggccgctttttcagcgtcctgcttgacgcgcagcgccgctgccaatcgctggtctgcttccttttctgcggcgcggcgcgccgcgtccgccgcgtcgaggacgcggtcggcctgcttttcagcgtcgagcttcgcgcggttcgcgtcggccagcgcccggtcggcagcctgctcctgcgattgacgggcgttctgcgctgccgaaagcgcggcgtcaatctcgcggtttgtatcctgctggcggcgctgggcttcggacagcgcgccgtctgccgctgtgacagccgccgtatgcgccgctttcgcctgcgcctggctgcgcctcagttcgcggtccgccgccttgagcgcgcggcggtgcgtaatctgggcgcggtgcagccggtaatcagccatatagctttcatattcggctgttttttccttcgcctggagcgcggacgccgtgcgcatcgaaccaatcatcggccggtattcgtgcgcagcccgctggatggtttcggaaagatcaagcttggacggacagacatagctacacgtcccgcatccgatgcacatctgcgcgtcgagcacgcgaaacaggccgtaccggcgattctgaatgctgcggtacaggtagaaggggttcagcccttcgggacatgcgtgcgcgcagcgggaacagccgatacagccgatgttaaggttcttgaaatcctcatgaaacgccaaaatggcgcgtgtggacggtgtgacaagcgtgttgtcggtatccatgacggaaaatccagtcatggagccgccgacaacgacgcgcgcgggatcctcaatgagtccgcaccgctcaagcacctggcccaccgtcataccgagcgaaacctcgagattggtgggattgccgatacagtcgccggcgacggtgataaacgtggtggtctgaggcttattgaacgcgactgcccgtgccagatgaatcagcgcgccgacgccgaccatcgcaacatcatcttctgcggcaaaatacatcgacgcctgatactctgccggataacggccgcggatgcgctggacggggaaaccaccgagctttttggggatacggatgtcgaggtcggtcagatttttataaacggcaaactgcgcctcggccgcgccagccgccttctgagcgagacgcaggccgctggcgctttgcgcggaatttttcaacatagggtttaattggctggaaatatacggttcgtcatcgatcgcatcggcaacgagcaggcgcgtcaaagaggcgcggaattcctccagcttttcaaaaagcggccggccatcacgttcgtcgacaatgtgcgcgtcgcgcgcgattgcgatgatatcatccggcgtcagcgcgtccgggtcctcgacggcggggcggtccatcagcacgccaatggtgtcggcgttgagaaattcgcgcagatcgcgcgaaagcgccggttccttgtgctgctggagcaatattcctttatataaaaatcctgccatgtgggacctccgataatcaaaaaatggctgtgcacatatagtaggggtgggggtgttggggatgaaattcagacagctcggcccgcatcgggtgcggattaatctgtctcgagatgaacttgacacaatgggactgagctacgatatgctcgattacagcagcgcgcgtacacgtgcgctgctcttttcccttttggaaaaagcctgcgcggacaccgggtttaaaccagccggccgtgtgctggtggaggcatatcccgacgaaagcggcggatgccggatcgaattttcaggcagcgccggcgcagcgcagcgctggcgtgtcaaacgcagcgcacagcttccggtgatctatgcgtttgacgatgtggatacactcatagcatgcgctgtcaagctgtttggccgctgcgcccagcgcatccgaaaaagcgcgctttaccatacagggaaaaactggatactggccgtttatccggcgcgggaacggcaggacgacacgctgatgctgctggacgaattcgcacggcgctgcggcgagggcgcgcttgccaaggcatggctgggcgaacacgcccggaccgttgtcgacgacaacgcggtcgggctgctctgcgcgtatttcggataagagatcagctgcgctgcgctgcggcgcgcaaatcgcgcacggccgcggcgtaatcgggcttgccgaacagcgcgctgccggcgacaaaaacatttgcgcccgcgcgcactgttttgccgatggtcttcagatcgattccgccgtcaacctcgatatcggttgaaaggccgcgccgatcgcattcacggcggacagcttcgattttcgggcacatgtcctccataaacttctgaccgccaaaaccgggttcaactgtcataacgagaaccatatcaagctgatcaagataaggaaaaaccacgtcagccggtgttttgggcttaatcgaaatcccgcattttttgccctttgcgcgaatggcgtcaatgaccgcctgcggttcgctgtcactttccgcgtggaatacgacaatatcggctcccttgtcgcagaactgcggcgcataggtcagcggatcactgatcatcaggtgcacgtcaagcacagcgtccgtcgctttgcgcagcgaagcgacaaccgggagcccaagtgaaatatttggaacaaaatgaccgtccattacatcgacatggatgaggtctgctcccgcattgtgcatggcggcgacctcggcgccgagcgcggcaaagtcgcaggcaaggatcgatggggcgattttcatcatattcataacctcccaggggcgcggcgtcctctgccggccgcgcgggcaaattgcgtttgccctcatattatatcgtaacgtgtcgtggattgcaaggaaatcggcccctggtgcggcagaattcacaggtcgttaacgttttcacacaaagctgaccagggcttgtttgaaaatagaggtattgccgaatttttcatagacagcaggagaatagaaggcaaaaaacgcaggaatcctttcggattgcgaggctttttaacgcggcattcgccgctggttgcagaaaaagacggtattttcgatttttcaaacagtcccttaagcgcattgcgtaaaatattgtcatgaaaacggcctgacagtattgacaatgcaggtgaaatttgctagaataaaatgcgtcgtttaaagcctgcgggtgtagttcaatggtagaatgtcagccttccaagctgaacacgtgggttcgattcccatcacccgctccaagccctcgcttccggcgcgcggccgctttgcgccagtagctcaaccggatagagcaactgccttctaagcagtaggtcgggggttcgagtccctcctggcgcgccagttttcccggccggcgcggataggttccttataaacgccgaaatggtgggtatagctcagttggttagagcgccagattgtggctctggaggccgtgagttcgaatctcattacccaccccaccagacagatcgtccccggccgcgcagcgggcggggactttttcaaagcggcctgtgcgccgcatctattgggccatcgtcaagcggtaagacacagcactttgactgctgcattcgtaggttcgaatcctactggcccagccagagcaaacccccgcaaacagcttgtttagctgcctgcgggggtttacatgcttttatgctcattctttggatatcgcaataagtagtgattaaatgtatccttatgtcgtaaaagtgtcgtagaatattagattgataaacggctataagcccatgctcttgcgcaaaacattgatatcattataaacatatattttagctgtaatgatgatatcggcgtgaacaagtacccgttggatggtatagatatcagtttgtaaaatctataacggagaatgctgaatcgagaggtgaacaagcaaatggctaaaactatacgcggagctgattcgcaagggcttaaaggcaatcggggacgtactcaaggctttacaggccgaggtcaaggagctgctcgaacatgagtagcttttttcttttcctcgcaaaaatattctgccggagggaggtgcgcataatggcagttgtttacgcgacgctgatcgtgaaaggcaaaaagacgctggaggacgttccggcgctgctcaaggagcaggtgcgggaaatcctctccgctctcgatgtggaagtgcagtaacatacgatggggccgggctggcgtaacagcccggccctatattttgcccagggggtgtaagtaatggcggatgagaaatgcatcgtagacccgcagcgggattgccttggcctgcataaggcaatcgccctggaaaagcagatgtcggaataccgcactcaggcgcgggaaacacacgccgatatgtataggcggattgcggcgctggaacagtccgggtccgcacaggaggcacgctatcaggcgatcatggacaaattgacggaactgtccgtccggcttaatgaggcgctagcgactatcgcggcactcaaggaaaaaccggcgaaacggggggagagcattgccgacaaagcgatatgggccgtgctcgcggcggtgatcgcctttgtactgggacggatggggctgtaagactggaggagcacaaatgaaaatcaattggaaggtacgcattaaaaacccgttgtggtgggttcagatagaggcggcgctggtactgccggtgctcgcatacttcggcctggcctgggaagatatgacctcctggggcgcgctgcgggatgtgtttctgcgcgcggtgcagaatcccgttgtgctacttgctgcggcagccagcgtgtttaacgctgtgaccgacccgacaacggccggcgttggggacagcaggcgggcgcttgagtataagacgccgaatcgtgacgaataaaggcgatcaatgcggattacggcttgtaaaaaagggcggcgcatggtaaaataatgctggcgctgtcgcaaacggcaggcggttagtcactcccttgcgaaagggggtgttatgtatggttgagttgttgctcgcgattttattggtcgtggcgatcacagaagccgtgaaatacataaaaaaatgaccgcccaaccctgcaaaagttagcggtcataccgtaatttgtaagggctaaccgtctgtcggcagcgcctctttgttttcattatatccgtaccggagatatctgtcaagccgctggcctttggcctgcggcttattgattggaagccacgggaatgctttgacagaagggcgtcaataattgagcgggcgtcatgccagttccacggctgatgcgatcaaggattttcaaatttgtatgcccctctgcgcgttcgattcttgcataggttttgacttcaataccgatttgaagcgccagatcttcctgactgagtccattgattgcgcggtattcaaaaaggttacatgccaatataactctgcattcatcgtacttcacaattatttcctcccgcttcgttttatacgatttatggaaataattgtataagtcagtcgtattttgtcgcaagagtgctaagacccttgacaagcttgtttaaatatgtattaaacatccaaaacagggtggcatatgccaccctgtaaatctgatatcttgtttattattgcgcttttttaagctctgtgatctgtgcagtatgagtttttacagtaccttccaaggtactcacgcggcctttcaggctgtcgacctccttggagacagacagcttttcaataatttcgctgtgctgctcggcgatcagttgaattttggggacaacagccgtttcgattatggcgtttacttgattgatgattcgtttttcttgttgctctatcatctgatataaatgttgattatcctgttccactttatcaagacgttcattagtggttttttgcccggcctcaaggtttttttgcccggcttcaaggtttttttgcccggcttcaagggctttttgcccggcttcaagggctttttgcccggccttaagctcttttaattctgctaagatttgatgcaacagctcattttccacacgatcaacccctcttttctactatagcatatccagagatagacatcaaggcttgggttcatcttccgggacgtaaaacaagtgtaaaattaattgaaaaaatactaatatccgtgctgcaatataatcgcaggttgcgggaaggcagacggaaagaagcgaaagcctaaccaagaaggcagcgtaaagccgggaacggcgcggaatacggttccacaaagcccccggctctcaaccagtagcaagggagagagcaaccaaagaaaggaggggttgcgaatgaagtttagagactttcagcgactgaccccgccagagcgaaaagtttactgggaatcatataaaaagcggctgactggcgcaacagtcaaccgcaaaaccgcaaggccagcccctagcaaaagcctctaccttgctacctccattataccgaaaagcaaagaaaacgcaaacggaggtatttttatctggacatcatcaatagatctgaggagatacacatgcaatttgtgaaggaaatcatccggctgttgggttcggccaccccgaaaagcagaaattgatattggcatttattaaagcgttagtttggggagaacatacaggttagaaattatcctaaatattgcacaaatttttaggtaaattaattttttggtttagaaaataataacaatatagatacataagaattgatatttcttcgtatcagggagaaaatgattttgagagggtgaaggcggacggcggacgcctgcgcccgacctatccggtgcacatggaccaggaatacggctctccctgcggtaacgcctggggagtgggaaggaaaagcagcttcgtaccgatacagccaaggtgtttctgaaggttctggaggacgccggatgctatgccgggctttgtagggcgtgtggacggcatttccgtatcgatggatatcaacgcctgttaccgggattacccggagatcattcggacaaatctgctcaacggctggaaaagtgcggacaagccagatgcgccaaccaatccgttcggtgataggatactgtccgtgtccacagcggaactgacagacttacgcgatagtttatcggtagttctctcgatgattacagagatgttaaaagctacataatattgtgaaaataataaaaaagccgccaaaagggagcgatcctggttgtaggatccgcaagtttctacaacacgttcagtgaatctataacattatattcccatacacttatcaacctaatgtgaccccaaataatggatggattgcgcatatgatggatgtcttgaataccggagcggcggaaatcaccgagtgggacgagagcataatccgtcagctggtggatacggtgacggtgctgtctgaggacagaagccatgtccgactgtatgacggcatgagttcgaacaagaactaggcaaggagagaagctgatatggtttacgtaaccggagacacccacggcaacttcaaacggttttgaaaaacctgcttccccgaacaggcaggcatgaccaaagaggactatcggcagcgaccgacaggatcgtgaggcacgccgcatatgcgagtttgagacgtaaaagtgggcgttgaaaaagcagctttcagcaaaagaagatgtgatcggtatcttaaaaaaatccgtcggtatcctgtccaaaccatagagaaaaagtagagccgtacccaaactcttagttatcagggagcctctgtggagcaggcattccgggtattggaaatctcacgcagcgggtactatgactggcgcaaacgctcccgggcgtatcccgccagaccgtgagcgaccaactacagatttgcgcggaagacgcgctctttcagtgctcccaacataatcagtctccatcttctatgtaggcctgcatatcgggccacaggtcgtccagacactggatggccttctgatacaagttgtactttttgtcataagccttggcagcttcgggatcggggtatatgggggcggacaggcggcacatggcagcagctgccttggtgggggtggcgtagtcgcccaatgcggtggcaacagccacagagcagcccagagcgccggtctcgtcagcggtcacggtttccacggggcagttcattacatccgcgaaaatccgggtccagaccggggagcgggctgcgccgcctgccagacggatgcggcacgggtggccgtcgcgggtatccagcagcttttccaggtgatggcgatgagagaaggcaatgccttcataaactgcccgaagcatgtgcttacggctatgggaggcgttcaggccgataaaggcagcgcgggcccgggggtctacgttgctggcggtgaggaagggcagaaagatgggcatgaaatcggcggcggagaactcctcagcccactgattcatcagagcgtaaatgctcttggactgcgcttttgcctcctgcaccagctcgggcagcagctgctggataaaccactcgttgttgccggcggatgtggggctggattcttcgatgagatagtactccggcaggcagaacagggaattcatgagaacgcggccgtcggtgacgggttcgcggcgaatgtattcgttgatgctccaggttccggcgatcatgcagatgtgctcctcgtccgtcacgttgacggccagagcgcaggcgtcgatatcaaacataccgccgatgacgggagtgccctctgccaggccggtggcctgcgcggcttcagcggtaatgcggccggcgatctccagagaattgcacagtggcggcagagcggacgcaattgcctcaatgccgaacagcttgagcaaggcggggtcaaaagacttggtgtgcagattcatcaggccgctgccggaataatcggtgacctcagcgcgggcctcaccggtaagacggaagcggacgtaatccttgcaggcaaagacccacttgatattttccagaacgccaggctcgtgatcccgcagccaggccagcaaagccaccggctggcaggccattacgtgctggcaggacaaggcaaaggcggccttttccgtgccgtcagttctccagtccatctggtatttccaggcgcggttatccgcggagagaataccccggcgtacgggctgttcgtctttaccccacaggtacagacctttgccgtggccgcacaggccaatgccggcgatcttcctggagttaatgccggttttttccagaagtgcccggatgacacggcagttatcctgccacatatcgtccatatcccgttccacaaagccgggggcgggggtgatagcatcggtagtggcagcctccacgccgatctgccggccttcggtgtcaaagagggcggctttcgtgctggtgccgccgttgtccagtcccaaataatatcgcatgtattattcctccattgccagagcaaattgctgttcgatataggatttggcggccaagatgtcctgcttccagccctggtcaggcttctaccacatttccatcatatagggacggtgatagccctgacgttccagctggcgcaggcacaggggaaagtccacgcatccgctgccaaaggggacacatttgaacttaccggggaagttaggtgtgacggccagggtatccttcagatgaacggctgcgatctccttgcccccagcgtcaactcagacgccacatcgctgccccaggcggtcaggttgcccgggtcggggtagacagtgaaccagggggtgggcagatcggcttttaaggctttgtagcgggtgatgctgctcatgaggggggtgtccatgatctccatggacagcatgacctgatatttctccgccagcgcacagacggaggccagacctttaatcccagcaagtgatctcctgacatagtagaaacgctcctttatgtataaatgtgaggggatcgcaatcagtcgggaagcagaaggggatgggggcggacgggatgggccggaatggtactgccgcgaacgttcaactgggtcccgatcaccattttgcagggggtggtgcagaggccgttgatggtgttcagcaggatctgcatagcccaatacccgatgtcctcgcaggagacatttacggtagtgagcggcggatccgccagagcggaaaatggaagtccgtcaaagccgacaatggaaatgtcttcggggacccgcagaccgaagtctttcaaggcccgcatcgccccgatggctatgctgtcattattggcaacaatggcggagggaagcgcgacgccggcctccagaagttccctggtggagcggtaggcgccttccattgtggggaacacaggaaagaccagccgcgtgtcaaagggtaggcccagatggtgcatggcgttctgaaaagcggcgcgccgttcctgatcgttactggcgggaagggaattataaaaaaaaccgatttttttgtagccaagttgtgccaggtgctccacaacggaaaagatcgccagctgattatccatggtcacgctgctgaccggaaggcaagacagagagttgtccaccaccagcagcggcttttccagggggaggaagggagccatatcgttgggaatcaatctgtaccgaggaaaatggtgccctttatggcgggttttccgatcaattccttaagagcggcactggacagtgaggcatcgatagttaccacctgaaggtcgtacccggacttgcggcattcctgctccacggcgtccatgatctgggtcacaaagccggggttgccgttgaccagatgcgcgtggcggagatacttgagaaagcagatgctgcggttgcttttgctttttccctctacatcgtagccgttttggcgcaaaaggtccttcacgcgttcacgggtctcggagctgatgccgggctttccgttcaggacaagggataccgtggtaagtgatacgccggcttgtttggctatttcgcgcagattcatgcaacaccctctccttgggattttagtaaacaattaaaaaatcagaaaatataaacaaaaaatatttaaaattatattaacacatttaaaaaagaatgcaagagtgggggcgagaaaaaacggggactgtttttgcgcaaaagtgtgaaaagcagtaaaaattaagaaaaacagacaagcatttggtcagaagttcggaaaatttgactgtaatatagaaaaatatataaaaaattatataaacttccgaattgacttattgaaacatcatgctatgattaaaacaataaatcttttatattgggatggaactatcggtgtttagtaaacaacgatagctgagaagatagattgggtatccgcagaaaaaggaggtcgttatgtcattatgaagaagatcttagcgatgatgctggctctggttatggctctgagcttggccgcctgtggtggccctgcagggaattcccccgcaaccgagaagcccggcgccgagacgagtgctcccgtcaacgagggcggcctgccctacgaaggccatacgctgtacgttgccaactggcagggttacaactccgaccaggcctattgcgagaaggcctttgaggatgctactggcgcgcaggtggagcatgtttattttaactcttatgacgaactgatgacaacgctgctgaccggcggcaataagaccattgacgcagttgttctgtccaacaactacacccagtggttccacgacgatggcctgatctctgacctggatgcctccaagctgcccaactatgagaagatcgccgacgtttacaaggaccaggccccctatgctgtggatgatgcaggcagcctgttcgcagtgccttggtgcagtggcacatcttccatcgcttataaccccgactatgttgatttcgagatcgagcactggagcgacctgctggatccccgtctgaagggccatgtcatggttctgaacggcgacggcgattcctgggtcatcggctgcctgctggccggcgaagattccaacgatatcgagaacgccgacatcgaaaaggtccgcgcctccctgaacgagctgaagggtcagctgctgggcttctggagtaccaacgacgaacagatcatgccctggatggccggtgacttctgggccggtgagatctggtccggtccctacagccagttgctgcacgattccagcaccaatatcaagctggtccaccccgaagagggtaccgttggcttcatcgactactgggccatcgtggaaggcaccgacgagcaggatctggcttacgagtggctcgactggatcatgagcgccgaacagcagacctccatggctaccggcatcagcgaagcttatcccggtgagtacatgacttacacgcccgtcaacgcggaagttatcgaggcgttgactcccgagcagaagatcgatctgcagctggatcccatgcccaccaccatcaagctgctgccctacatcgccgatccggcggtgaaggatcagtgggtcgacctgtatcaggagtttgtcagctgatataagatcatatcattcgcagaattcatcaatagttctgacagaatgccgccggaacccctttcggcggcatttcctttaaaaaaaccggggggtggcaaatttaaatgagtagtttgagtaaaaagaaattccagctcgtgacactatggacagcgcccagtatcgttttgctgctgtgcctgacaatcgttcctttggtgatgctgctggtgttcagctttatgaaccggaatatttttgccggtgagccttggccaggttggaccatgaacaaccttacccgtatgatcgagtccaatacgttctggcgcctgttgggcaagtccctgatgacggcgctgaaggtgacgctcatatgcattgtggcggcctatcccacggcctgggccattgccaagatcgtgaagccgaaaaaccgcagtattttcatgatggtagtcattctgccgtttttcacctcccagctactgctgatctacgccatgatgaacctaatccagtccggcggtctgctgctgaccttcttggacgccatcggtttccataacgtccccaccatgctgtataccaacaaggcgaccattctgatcctgacatacgaatatctgccttatatgatcctatgcctgtactcctctttggagggcattggcgataacctgatccaggcttccctgatcctgggcgccaacaagtggaagaccttcaccaacatcgtgtttcccatgagcgttcccggcctgctgtccggcgttctgctggtgttcgttcccgtggcgggcagctttatggaacccggcctggttggcggcgccaacggcgcgatggtcggcagtatgatcgatacgcagtattccggatcgctgaatatgggctatggcgcggtcctgtcctgtacgctgctgatcgtcctcagtattattatgggactggttcgtctggcgactgccagggcacagaaggcaatcggaggtgacgtggaatgaattccaagggttttaaccgcgccatggtggcgtgcctgtggatcgtattggcattcatgtacatccccatcatcgctattattggcatgtcttttaatgccacgccctatggtatgttcccttatgtctttacctttgactggtacaagatcctgtttacggagagcaacctgctgcccgcctgcgtgttcagcctgaagtttgccttcggcgtgacggtggcggcgatcattattggcacaatggcttcctttggcttgcaggcctactcccccaagtggtcaaatcgtctcaatgcgttgatccagctgcccatcatcatcccctggctggtgactgctatctccctgctgctgctgttctcctttatcggtgcgggccgtagcatggtttccatgttcttcggtaacctgatcgtggtgctgccctatgtggtgctgctggtcaatggccgttttgtgtccatggaccgcacaccggaatctgccgcacggctgctgggcgccggacctgtccgcgtgttctttgacatcacgctgcccgccatcgtccccggcatcatggccggcggtatcatggcgatgatcatgtgcttcaacagcttcgttatgcagtactacctgatccccatcggaacccagacgctgcccaccctggtttttacccgcatccgtagcggctatcaggcagacctgaacgccctttccgccatcattgttctggtcgcggtcggcattgtgatcctgctggtcaagctgggcttttcggccggaagcctgttcggtatgtcctccggttcgagctctaaaaaaggagaataaatcatggctgagttgagagtaaataatctgaaaaaaagttttggtcagaatgaagtgctcaaaggtgtcagcttccatctggagactggcaagttcctgtccctgctgggtccctccggctgcggcaagaccaccattctgcgtatcatttgcggtctggagaccccgagctccggcgaagtgctggtagacggctcagatatcaccaacgtcaagcccgaaaagcgcaacatcggcctggtgttccagaactacgcactgtttccctccatgaccgtggccaagaacgtgggctatggcctgaagatgcagaaggtcccccagaaggagatcgacgagcgtgtggaagatgctctggagctggtgaagctgcccggctacggtccccgcaagatcacccagatgtccggcggtcagcagcagcgtgtggcgctggcccgcgcactggtgacccgccccagcatcctgctgctggatgagcccctgtccgctctggaccgtaagatccgcggcgagatgcagtatgaaatccgcaacattcagcagaagatcggcaccaccaccgtgttcgttacccacgatcaggaggaggcgctgaccatgtccgaccggatcattctgataaacaagggcagcattgagcaggaaggcgatccctatactatctacagccagcccgctaccgagtttgcttctgacttcctgggcaaggcaaacctgatcagcggcaagctgatgtgcgagaacgataagtggtatctggtgaacaccggtatccgcatccccatcaactactgcggtggcaaggaaggcgacgacatcaaggctgcggttcgcggcgagtacttcgagttctgtaacgaagaggcggaagacgccaatgtcttccgtctgcagagaaagatctttaccggcctgagctggaaactgatcggcctgctgggcgaccagcctctggacatctccgcgctgggcatcagcgcagaccacctgcaggagggcgcgccccagtatgtccgcattcgtcctgagaacgtggtctactataacaactgattttgggggttattgatatgagcaagcactatgaaaccgcccgggagatttatgcctcctggggggtcgataccgaggaagccatccgccgcatggacgagatccctctgtccatcaattgctggcagctggatgacttgacgggctttgaagattttgatgcgcagctgaccggcggcattcaggctaccgggaatgcacccggcaagccccgcagcattgaggagtattttactaatctggacaagatgctgtctctggtccccggcgcaaagcacctggctctgcacagcgtttatcccctgaccaatggcgtgaagatcccccgggatgagcttaggcccgagcattttgctccctggatcgattatgccagggaaaaggggatcggcctggatttcaatcctacctacttctcccatcccatgctcaaggatggctggaccctggccagccctgacaagggcgtccgggacttctggattcagcacggtattgcatgccgtaagatcggcgagtcctttggcaaggcgctgggcgagacctgcatcaccaatcactggatacctgatggctccaaggatacccgcgtggatatgctgggtccccgtgagcgtttgatcgattctctgaatcagatctttgcggagttcatcgaccccaagtacaatcgggactctgttgaggggaaggtttttggcttgggtgtggaaagctatactgtaggttctcacgatttttatgccaactatgtcctgaccaccggtaaggctatggtctgcatggatatcggccactatcaccccactgagagcgtggcggataagctgtcttcctacctcgcattcaaccaggagatcatgacccacctgtcccgcggcgtccgctgggatagcgaccatgtggccgtcgtgtctgaggaaattgttgccatcatgcagcagatcaagcgctgtaacgccttcgacaaggtacatctgggcctggactttttcgatgccagcatcgaccggatcgccgcttccgtgatcggcagccgcagcgtgaaaaagtgcctgatgacggctctgctggagcctactgagcgcctgatgaaggctgaggctcaagaggatctgacccgccgtctggcgctgcaggaggaattcaagatgctgcctgccggtatcgtgttcgacgagtactgtgagcgtcacggcgtcaaggcttccaactggatgggcggtgatttgaaatgagcgagctccgtcgttttatagtagatacagacacaggttccgatgatgtctgggccgtgatcgaggcgctccgggctgtagacgttgttcgggtggaggccatcacggtggtttgcgggaacctgccgctggatctctgcgtgaagaatgccatgcatgcggcggacgctgcgcgcacctatgtgcccccgatttatcggggcatggagcgacccatcatgcgcaagcaggcattttatgcggccgatatccatggggaggatggcctgggcggcatgaatctgcctatgccggagagtcctgtggaaaacaaacatgcggtagacgctatcatcgacatcgtgatggccaattccggcgagatcgagatcgtcacctgcggccctatgacgaatttggccatggcactgctgaaagaacccaagctggcggaaaatatcaaaaaggtttggatcctgggaggctctgccggcgtgtccggcaatatgacccctactgcggaatacaacgtgtacgtggacccggaagcggccgatatcgttctggacgctggcatggacactgtttgggtcacttgggatacggcggcgggcgaaacggaaattacgcctgaagaagtggagatgctgctgaacagcggttctcacacggcggaattctgtgttcgctgcacccgtaaactgcgggagtactacctgagtatgtatggccggccttcctatagcgtcattgacagcctggtcatgacggcggcgctgtatccggagatcatggaaggcgtgtttcaagcaaactgcgccgtggagagaataggaacggagacgcggggatatttccgcatcgaccgtgacaaccgcttgaagcgatctcccaacgcggcgatttgtccggcggtgaatgtcccgctctacaaaaaacacttatttgcattgttgggcgccggctaagtgaaccgactggctccgctcaggcggagccagtactgctatgattgaaaaaggagggcctcatcatgaatgactttagattttataaccctgtccggattcattttggacagagctctctgaacaagttgccgaaggaactggcggctgtgggtaagacgatcctgctggcctatggcggcggcagtattaagcgtaccggcctgtataaccgtgtgatggccattttggaggactgcggcaaggaagttgtggagctgtcaggcatcatgcccaacccccgcaccgaaaaggtctatgagggcattgagttgtgtaaaaagaacaacgtggactttatcctggctgttggcggcggcagcaccattgactgtagcaaggccatcgccgtgggcgcctgcaccgaccgtgatttctgggaggcattttatctgaacaatgaggctgccgaagcagccattcctctgggcgtggtgctgaccatccctgctaccggcagtgaaatggatcgctctgccgtcatcacccattgggagaccggcgtaaagaccgactacaactccgacctaatcttccccaagttctccattctggacccaactctgacctatacgctgcccaaaaaccagatgatcaacggcatcgtagataccctgagccatatctgggagctgtatttctccgagcctgataccgacagcgtgacggataatctagcggaagcgctgatgcgcagcgtgattgctgcgacccgtgtcgctatcaaggagcccgaggactatatcgcccggtccaatatcatgtgggccagcaccgtggccctgtgcggcatgataggcaacggcaagaactccgactgggccagtcataacattgagcacgccatttccgcgctgtttgatgtggcccatggtgcgggtctggctgtggtgcatcccacctatatggcgtatttctgccagaatgctccggagcgctatgcccgctatgccgtgaatgtgtggggcgtggaccccaccggcaaaaccgcgctggaagtggcccgcgagggtgtgcagtgcacccgcgacttcttcaacgagattggcgcgcctgctactctgacggatctgggcgtccccgagagcgccattgatgatctggtggcgcacacggacatgggcgcatgggcttataagaagatgacgcaggacgacgtgcgcgccatcttgcgtatggctctgtaaggggggaccgatggaacagatttctgttttcgacagccgcttcgcaccatacggacaggtgctggaaggatatgatttcgcagaacttttacggattatggaagaaacgaccccctgcccggaggatggcacagtctatgtggcatctgtcccggaactggaggcactttctgtggcggcagagctgcgggatcgcgggtttggaggtatgcccatccagatcgggtactgcaacggcgccaacacccgcctcagctgtctggaatatcatcgcaccagcgagctggatatcgctgtgagtgacatggtcctgctggtggcccgtcagcccgagatcgtgggcggtgtgttggatactggctgcgtcaaggcgttcttcgtgcccaagggcacagcggtcgaactgtatgccacgaccctccactatgcgcccgcggcggttggccatggattccgcatgggctgtgttctgcccagagggaccaatggggatgcccccaggatcacgcctgtgggaaaagaggactggctgctctggggcgcaaacaagtgggtcatcacaagcgtcaataccgatgaggcgcagcagggcgcctatgtgggcatccagggtccggatgtggacttgatgaagggctgagcgaggagggcaacatgcaggaaaagtggatcgaaaagatctatgccggttttctgggcatggatgcaggtatgcgcctgggcgcaccggtagagaatccctactggacctatgagcgtcttgaggaatactatggaaacatggaaggctatctgcgtgaatatcgacactatgctgctgacgatgatgtcaacggcccggtaattttcttgcgggttctgattgactggggcaaggactttacccccaagcaagcaggcgagacctggctgaactacacgcgctgcggtcacggtatgttctggtggggcggcgaggatatgtccacagagcaccgcgcctatatgaacctgaagcgcggggtatccgccccaaaatccggcagcatcgctctcaacgggcaggtggctgccgagcaaatcggcggtcagatctttgtggatacctggggcctgatctatcccggcgatcctgccatggcagccaagcaggccagaaaggccgcctctgtttcccatgacggcgaaggtctgtatggcgcgcaattcatggcagcctgcgtagctgcggcatttacctgtactacggtagacgaggtgctcgatgccggattggcggtcctgcctcgggattgcgattaccgccgtgtggtggagtctgtgcgggccttccacaagaagcagcctgatgatttccgggcctgccgcaattatgtggatcgggagtggggcgcccacaagtaccccggttactgccacatcatccccaatgcgggtatttgcgtgctggcattgctttacggtaagggcgagttgggccgcaccattgagatcgcttgtatgtgcggctttgatacggactgtaatgccagcaacaccggcaccatcaccggcgttcttggggggctggaaaatttccctgcccgttatcgcacgtcaatcaacgactgtgtggtcttgtccagcgtgtccggcttcctgaatatgctggacagcgcagcgttctcgaaggagctggctgttctggcttaccgtctgcggggtgaacaacctcctgcctggctggtcttgccccgacccggcgatatgctgatggactttgagatgcccggctctacccacggcctggaattgacagaccgggccagccattggatccgccctgtggagggcgaagcccacaccggtaagcgctgtctggagatgatgatcgacggaaaactgccggttcctgtggatctgttcttccgcggcagctttatgcgctctgacttcaacgatgagcgttatgaaccggtgttctctccccgtgtctatcccggtcagacggtttcctgctggatgaagagtaagcaggaagcgcccgctgccattactgtgacgccgttcctgacaacggcagtaacaggccagcgaaaagagctggagccggtggtgctgccggataggacctggcgccaggtctccttccgggtgcccgagcttgcaggcgaccaggtccatttcattggctggaaggtggagatcgaccccatgacgccgccctggacgctgggccgggtctttgtggatgacatcacagtcaccggccccatggcctacgccatcgatatgtccattcagaagaaggagtttgatgagatcacgcccttctcctgcaatgatattcagccggacctacagtatggtgaactggtactgcggacggagtgcggcggacaggcctttaccgggaattattatacccgggatggggccatggaaggcgaagccgttgtggagagtggagattcctgtatgctgcttctgcggggcaagggcacccgtaacttctatgcgcttgggcttgacggcgaaaatgcggtcattgcatgctgtgaaaacggcgaatggacgcagctggcagctgtcccgtatggatggcagcgcggtgaaacgctgcggctccgggcagaggccgaaggcagcaacctgcgcctgctagtagacggcgctttggtgctgcaggcagcagatgaccgctttgcttacggcatggtgggcgtgtgccaccccggcgctgcttccagccgctggaaaatgtttgctgtgaccggccagatataattataaaaattacccgatcggaggatcgggtgatttcaggttttcgaaaaccctgctgcgcatgaagcggcggcagggtttctggcatattagagatagaataggctcaaagaggatatggtggagagagaaattgaacaggcgctgattcaagacattaccaagcagctgctcgaactgggaaccggatttgctttcctggaaaaccaatatcatctgaatgtaggcggcgacgatttttatatcgacctgttgttctataacttaaattttagctgctatgtggtgattgagttgaaaaccggcgagttcaaaccggaatatgcgggacagctcaacttttatctctttgctgttgacggtattttgaaaccggatcaggacaatccatccattgggccgctcccgtgcaaaagtaagaatgacttggtagtggaatattctctgaaggatctgagcaaaccgattggtgtcagcgagtatcgcatcaccatccggttacccgaagaattggagaaacaactgtcttccattgaggacattcaaaaaaggattcgctgatatttttagcagacagcacagagtggttccaaagtgagcaggcttgctaccggacaagagcctggagtcaattcgtgcaccgggatttttcctttttctcaaagctgctgcccgcgcttaacacatagtgttttggcccagtggctgcttttttaaaacgactttgcaggagcagaggaaacagcaatatcatgcttaaatttgctgcgatataggccgatctctaaatgtgaggagtcagcaggtccatgacaggcaatccggtcccttgactgagcttgtcgagcgttctaagggaggattgaatttccgcacgttctattttggtgtagccgcttacacttaatccgcttttccaggccaattcctcctgggacagatggttgtcagaacggaaacaaagcagattgtttgccaagatgtcttttgattccacagtgattcctcctcaaggttgttcagacgctataccacgatgcgtacgttcctggattggtacagccttttatgtctattgtaaaagcaagtagaattattatccaggtacgatcggctcttgacaagaaaatttgtacaatataaaggacagattggctcgataaatagccaaatagaaaataaaaaagctttaaaaccgttgaatgaaacgggcgcggcctggttcaagagtgtggaagtccccgacgctaggatttttatcatatgaattaaaaaataaaaataaagagccgccggccacgccggcggctctttatttttgttcagtcctttatgcggatagcgggattgcatgcggctttgtcatcccatcatgagatttggaaacagcatggaaatggacgggatataagtaagcagcatcagaatcaccagcatggagatcaggaaggggacgatgccctgaatgacctggtccagctttgtttcaccaatgcggctggctacgaacaggttgatgccaaggggtggagttacaaatccaatggccagattgacaatcataacaataccgaaatggatgggctctacacccagactcgtaacaatgggcaggaagatgggcgccaggatcatgatggacggcgcggtatccataaagcagcccacgaacaaaagaacaatattgagcagcagcagtataatcagcttattgtcggtgagccgggtgatggcgccggcgatctgctggggaatttggccgatggtcagaattttggtgaaagcggcggcgcaccccagtaccaccagtactgtgccggtggtcagtccggcgctgcggatgacgccgaagatgtcgcgcagccgcagttccttgtaaatgaatacgccgacaatgaaactgtaaacgaccgatacggcagcggcttctgtgggtgtaaaaatgctcccataaataccgcccaggatgatgaccgggctgataagcgcccatttgccgtcccaaatggcggatagggtgcgtttgaagctgaaggggcgtccgtccccgctgtagccccgttttttactgataaaataggcgacagtcatcaatccgagtcccatcagaatgccgggcaaaaaaccggccataaacagctcggtgatggattgtcctgtcgaggtgcagaagatcaccatggggatgctgggcgggatgatgacgccgatacagccggccgcggcgatcaatccgagcacgaaccgcttgtcatagcccttttccagcatggtggggatcaccatgccgccgacggcggctacggtagcaggtccggagccggagatggcggcgaaaaacatacagactacaacggttaccagtgccaggccgccggtgattcggccaaaaatttcgttgaaaacattcagtaaccgtttggagatgcccccgccgcccatcagttcgccggccagcacgaaaaaggggatggccataatcgggaaggaatcggtggaggtcaccagattttgagcgatatagccgatgcttagacccagggaaggctccgctacaacagtgatcagcgaagcggcgccgatggcgatgccaacaggcacattgagtatgatcagcaggaaaaaagcgccgaacaggattaggctaatcatccaaagcacctccttgccgcaggcactttactctaagccagatggtttgtaaagtccggtaaaaggtgaggacgaatcccacaaagggcgccatatatacaaattgcattgggatgcccattgcggcggatttttgccccagcatggcgattttcataaacagctcataggaggttttgatgatgaaggcggaaaacaacagtacgacgatatcccccacaatgcaaatatatggacgaattcgttggggaaacagccacaaggcggcgtcgattttaatatgcttgcgctgcttggcggcatagccgatggccaggtagaccatccagataaacaaatagcgggccagttcctccgaccagctcagagaattgttgaagatatagcgcataatgacctggacgaagattaaaagactcatcacacacaaaaggacgaccatcaaaaggtcctccaaatggttgtcaatttttttcagcattgtttcaccccttgtcccttctgaatggacgggcagtttgcctgcccgccctgcgcaagtttattcctcctgcaatagctccagggtccggtcaaacagttcgggatgctccatttcattgcgcacaatgtcgttcacgctttggacggcctgctgaaactgcgctgtttcctctggtgtcagctctatgatctgggtggtcgcgtccttggcgatggcgtccaatgcctgctgttcatactgcggggcggtcgtccgctcgtattcggtcgcttccctggccgcgtcaaggacaatctgctgaaactcatcgggcaggctgttaaacttttcaaggttcatcgccaggaccagcggattatacatatgcttggtcataatgagatagctttgtacctcgtttagcttgttgtcgtaaatcagctccaccgggttttcctgtgcatcgatggtgccctgctgcaaggcggtgaacacctcgttgaaggccatcggcgtggggttggcgcccagggctttccaggtggccaattgaatgttgttttccatgacgcggattttcaggccgctcatgtccgcgggggtatgaatttcccggttggcggtcatgttgcgaaagccgttttccggataggacaggatcttaagatttttgctctccagtcccttggcgatctcttggccgatctctccatccagaatttcaaaggctttttcacgcgtttcgaacaggaaaggcgcgtcgaacaggtacaggtcgctgtaagtggctgctaagggggcgacgtttgacaaagtgatgtcgatatcgccgatctgagtggcctccagtacctcgcggtcggcgcccagagagttgtcggcgaacacattgacctggatctgaccgttggtgcgcgattcgaccacctctttgaacttggcgccgatatccttatgcgactgggggatccccacggccactttcagggtataagcggcctgttctccgccgtccgaagcggcggagccggccggcgccgcgctgtttgcggaaccggaagcgccggagcagccggccagaaggccgcttgtaaaaaccgttgctgcaagggccaaagcaatccgtttgccagttttcataatgaagtcctccgttcaatttagatgtgtgggggatggctatagctgttcagagaagccccaattcctttagccggatttttattttttctttttcctcctgcgtggccgggacaaagggccggcggggatagcattttacaatgccgcgcagctccagcatggcatagatggccagctgcgtcgagcgcgccagatacatgatatcgcgcatttcattgacttcaaactgcgttttgcggcaggcttttatatcgccggccatcccctctgaaaacatctttcggcagatttcggggaaggcgttgccgattccggggatgaacgccttgcagcccaggacacaagcgggcagccacattgcctccgtgccgagagccacgtcgaaggcgtcgctttttaaaaggcgcatatacttggccatggcctggatgtcaaaggtggcgtccttgactccgctgacgcccactttctctttcagcgtgcggatcagctccagttccataggatatccctggaattgagggttgttgtagacatagaccggaacgcggccctttgccgcgtccaccagcgtatgaaaatagtcgcagatgtcctcgctggaatgcttaaaatagtaaggtcccacggccgccaccgcggcggcgccgcattggatggcatgttccgtcaggcgtgcggcgctgagactgtcggctgtgcccacgtggacgatcaccgggattttgccctgggcggccttgagcgtggcttctgccacccctttgcgctcctcctccgtcatcagcacgccgccgccgtaggagccgttgatgaacagcccatccacctgtccggataaaaattggaccaatgcggacagcccttcataatccacctcgccgttttcacgaaaaggtgtgaccatgggcggcaccacgccatacatctgaaacatcttacatcatcctttccaatgatttgccgcgctgtatgcgttcgagggcgaccgctatggagccgtcgacggtcatccggtcaaggtcctccttgctgtgaacgcttttaatctcaagctgccggccaaactcctttttaagcatacatgtatacatcctgcaccggctctcatggccgtagagcaggtaaaagtcgctgtgatatccctgactgcgcatctcatgaaaggccttcaggtcatccgccgcgatggccgcgtccacaaaaatctgccgttcagagctgtttgttttcatcaacacctggagaaacctgggcatcagcatggttctgcccagtccggcatgatgcacgcagtccgccgcaatttcaatcaattcctcatacccgtagccgccggcttcctcgccttcaacgggcacgatgcttttgccgatgttggtggagctgaccatagcctcgtaaaactggccgctgatggtggtggcgcttgcttcgatctgacgcgcttcgttgatgtacatgatcttggtgtgtgaggacagcgcaaccagattgcacggatagggaaggctgtactggttcatgatcccgatacactgcacctcctcgccgcgcataaagtccacctgacgcagattctgcgcgcgtaccggttccggatagcggttgcgcacgccccggataaaatagaccggcctgcccagaggcagcacggactggtcggcaacctccaaaatcccgtcggaaagctcaggcagcccggccggcgcgacgagatgcgggatttcgatcaatcccacctccgaggtgatcatgccggaagcgatggcgaacgccacctgatccgcagggatctgatgttcccgcagaatctcaaaaaacaactccgtgacgccgtttcgcagtttgtcgcggctgccggtgatcgaggtgtcccgcacccccacctttttccggccggacgccacgatttctttttggtcattcaccagataaatgcgggtcatggtggtcccgcaatcgatgacggcaaacataacacaaaccctttctttctataatttggggtggtttaccggattttgcggcgtttcgccccttaaaacacgggcgacctcctccgcgaccttccgctgaaggctggcgacggcttcctcagaataccaggcggcgtgcggcgttacgaccgcattgtccagcttgagcaggggattgtcagccgcaaccggctcctgctcggtgacatcaagccccgccattgcgatttgcccgtccgatagcgcctggataagcgcctgctcgtcgacgacggcgccgcgggcggtgttcacaagcacggcggttggtttcatcagccggaacgcttcctgattgaagatatggcgggtgctttcattcagcgggcaatggattgatagataatcgctgtccataagaagctgttcaaagctcaccggcgtcacgccaagctcttgggctgcctgctgatcgagcatggggtcgtatgcgatcatctttaaaccgaacccggccatcttctgcgcgaccaggcgggggatacggccaaagcccatcagaccgagcgtgctgccctgcatccggtgcaggggcttcaccaccgtgtagctgctgcggccggccttcacctgacttgccaggaaggtcagttttttgacgcagtccatcagcagggcgatggcatggtttgacacctcgtcgatgctgtaatcgggcacgttgcagacataaacgccctgttcctccgctgctttcagatcgatgttgtcgacaccgatggcgtaccggacaatgaccttgcagcggggcattgcccggatgacccgcgcggtgatgggggcgaactgacagatcagggcgtcgcagtccgccgccgctgaaatgacctcgtcctcggtggcgcagtggtaatcaaacagctctccgcctgcctgccggatgatctcccgctcctgcgcgatgctctcatagtaatagtcggaaatgacaacctttggctttttcatttgacacctcgctttaaaagttttactatataaaacttggttttatatattgcttattttttaaaccttgcacccttgtgcaaggtttaaaacaaaccggcggctctactccacatagcccatttcctttgaaatctctgcggccgccgcccggatctcatgaagatactgctcggacttctttccaaagatcatatcctgcatcccgcacaggctgatccctgcgatcatttttcctgtttgcccatagataggggcgcacaggctacaaacatacggttcattttctccgacattgccggagtatccgtcccgccgcgcctgccggatcagctccatcagggcgcttttgtccataaccgtgcggtcggtcaggcgtttgatttccacacggttcagataacgctccacctcctcgtcgctctcctgcgccagaaacagacggccgatgccggtggaatacagctcgcttctgccgccgctctgaaccgtcagctgtgtccagagcgggacgcttttgggaagcacctgctcaaccatggcgagcgcgtcgccttcgcggatgccgaggtagcagatcatgttgttgcggttgcagagcttctgaaggcgcttctttgcgattttgcggacatccagagaattgtatttcaactgccccagatgataaacttcgatcccaagactatactttttggtttcctcgtcaaaggagataaagctttcgttatttaacgtatacagcaggcgcagcatggagctttttccaataccggccagctcgctgagttcagagagcgacagctcctgatgctgctcgtcgaacagctttaaaatctccaacgccttctttacggagccaattgtataatcccgagttgtgttcatattgccttctcctcatttgaacaaacggcggcggaggccgcggccctaaaagagcacaacacccttgaacacgccggcctcgggacgcgtccaggcggcaagcgtctgccctgcgtcgtcaaaggctgcctgatgggtgataaattgcctggggatgaaagcgccgagccgccagaaattcatcacccgctcatagtcgggccttgtagagttgcgggtcacaaacagagaaggctcttttaaatggaaccgcagcccatccaattccaacgtgccgccgcagatgcccacaaagacaattttcccgccctggccgatccaacgccaggtctgctccatggaggctttcgcggcggtcgtatcaatcaccgcgtcaaaaagcgagtcctctgtgaattgtgctgtttgttctgtaaaatgttcatccaatgggtccagtgccaaaagccggaaccgttcggccgcgaaagcccgccggcccggatttgtgtccgacaggagcacgcgcgccccataggtctgagcgttcagagcgcagcttatcccgatcggtcccgcgccggttacaagcacgcggtcgccgggcgccagttccagcttggccgcggcgtgggcgccgatggtcagcggctccagcatggcgatctcctgcgcgggcgctggccggtctgttttcagccagttttgagccggtgcggcaaggtactcctgaagccctccgtcctgatggaccccgtacaggttgagccgcgcgcaggcgtttgtccggccgcgctggcatgctctgcatgtcccgcaggggatacagggcattaagcagacctggtcccccacggaaaaaccccggacgccttcaccaacctcagctacccgcccggcggcctcgtgcccgatgacgcgcggaaaggaaaacaaaggctgatcgccccggatggcatggagatcggagccgcagatacagaccgcttccatgcggaccaaaagctggcccggaaggcattgggggatggggcgttcctcatagcggaaggtattcgcccggtcgagtacaagtgctttcattctaccccctcccatcctattttgtcaaatatccgccgtccaccgggatggtggcgccgttgatatagctgccagcgtcgctggccagcagaacagcgattcccttgaacgaatcaggctccccccaatccccctgcggaatgcgggacaggatgtttgcgttgcgctgcgggtcgttgtacacggcggaggagaggtctgttttaatccatccgggagcaatggcgtttacattgatccccagactgccccattcgctggccatcaggcgggtcatccccattaccgcggacttgctggcggtgtaggcggctgtattgattccgcccagataggacatcatggaagcgagattgatgatttttccgccgccgccctgcctgacaaactgcctggcggccatttgggagagaaaaaatacggacttttgattgacctggatgatattatcccacatttcctcggtatattccagcgcagaggcccggggacagatccctgcgttgtttaccagaatatccagcctgccaaacgcattcaaggtctgttccataatggctttcaactgcggcatctggccaacatccgcctggattgggagaaacctgcgcccaagcccttccacgtaccgctgcatttcgaccggcggacgggttctgtacacacaggcgatggatgcgcccgcctccgccaatcctttggtgatgccgctgccgatgccgttgccgccgcctgtcaccagcgcagtcttgcccttgagtgaaaagtcgtcaaaaatcatggctacacctcctagttttattagataaaacttaattttataatataaaattttgtacgtttagggtatcacaaaaaagaggggtttgtaaaggggcaaaacgacacattttaaaaagcatttgttggcgaaatttactaaggggtgcgcttgaagattcggtaaatcagatttggatgcaggtttgactttatataaacagccggacgggcattgacccgtccggctgtaaaaagacgctattaatgcgctgctcccgctgcggtttacatatccgaaatgctgtcgaaacgcacgaagggcaggctttcttcaatcaggatgcggcactcggcggtaaagatgggttcgtccatagtccgctcccctgccagatattcgttcatcaggttgatcgcgttgtaccactgctgggcggggccttgccagatagtcgcaccgatgatcccctcgcgaatataggtgtacgtcatttccgtgcgctcataaccaaagacgagggtcgaaccgacgcggcgattatttttgacggccgccgccgcccactgtgtcaagccgttggtgacataaaaaacgttcatatcggcatgcgcctgcatctgctgttcagcaatttcatagatgctttggtaggcgatccgttccgactcgatcggaatatcgcagacctcaaggatttttgccgtggggtcgtgccgttttaaaaagtctgcaaatccggcgagccgtttctgcgtaccttcgaacaactgattggccgccagcacgacacagcggatgccggcgcccttatagagcagggccaagcgtcctgcaagcagtcccatcgcatagtcgtccgggccaacgtgaaacaggcggcgtgaattcggcacgtcctcgatcacggtcgcatacggaatttcgggtgggatcagctcatcgagctgggattcccggccctgcaccggcagcagcacaagcgcgtttacgccttgtgaaagcagacggagaagcgcctccttctggtcgcggaaggagtaggtggaaaccgtttcgaccgccagttcaacgccgaacggcaacagcttttcccgcgcgaaatggaccccgctcatcgcctccgcccagaattcgctctccacacgggagatacagaccccgattttgaagctgcttttacggttcaccagcgcgcgggcaatacggctcggccggtacccgagtgcttcgatcgcgctttgaaccgcctgcatattgcgcgcggaaaccttgccgcggttgtgcaccacccgatcgactgtgccgatcgacacgccggacagacgggcgacatctttgattgttggttgtgaggacataagccgacccctgatttcccctgaaaaggattttataatgcttattgcaaaatcttactcaatattatacatgcattccatccggttgtaaaggagcgggaagcgccgcgcggtgttcatccaggccgcaagccgccgtcttgaccagccagacgcttccctcgtccgggccgtcgcttccgatcgccgctgaggtgacgaggagggtgtccagcctgcttccgccaaaggcgacgctgctgacctgccgggcagggaagggcagttcttcaagaagacggccgccggaggtataccgccgcacgcagcccccgtcccaacaggcggtccagagcatcccctgcgcgtcaagcgtcatcccgtccgggaccgccgctccaggctcattcagcaaaacggcaatctgccggttggaaatcgcgccgtctgacacgttgtaagcatagcgatagatggcgcggtcgcctgaatctgtgtgatagaagcgttcgccgtcaagcgaaaaccccatgccgtttgaaattttcagcccctcgagcagccgtcttggcggctgtccgtattcaaaaagccaaagactgccatccctgttttcttcggtttttgttcccgcgagcacccggccggccgggtcgcagattgcgtcgttgaagcgttcgccgggcgccatcggcacctgccagagaagctgaaaatcgctttcatccccgccatatgggcagcggaataccccggactcggtcatcaggagcaggttgcctgcctggtcaaacagaaacgcgcccagctgatagcagcatttgagcaggcggcgcactgcgccgcctggagtgcaggcatagagcgttccattcaggatatctgtaaagacaaattcgcccgtttcacggtgccacagcggcccttcaccgagcgcgcagggcgcgagattgagccttaccattctgtgacgcagccgtcgtccagccggaaaacgggatttttccaggctaggtcaggctcctccatcgcgcgcaccttatcctcatcgacttcgagtccgagtcccggaccgcgcagcaggctgacaaagccgtcccggtactggaaaacggatttgtccctgaggtaatcgccgatctcctgccccttgttataggccataccgatgctctgctcctgaatgcaggcgttgacgcaggcgaaatcgacctgtaaacaggcggccagcgccacggggccgagcgggcagtgaggcgcgagcgccacatcatacgcctcggccatggcggcgatccggcgtacctcgctgatgccgcccgcgtgggagaggtccggctggatgatgtcgacgcagccgcgctccaacaggtccttgaagccccatcgcgtgtaattgcgttcaccggttgccagcgggatgctggtaaagcgatggaggcgttcgaacacatcgatgttttccacaagaaccggttcctcgacaaagagcggcttgagcggttccagctctttgagcagggtcttggcggttccctgatgggcgcggccgtgaaagtcgattgcgataccgaaatcagggccggccgcgtcccgcaccgcctgcaccttctccagcagcccggtgatggcgcggctgtcgttgatccagccgatacggccggtgccgagcatcttgatattgcgaaagccctgcgcttttttttcaagcgcggattttgcgcatatttccggggtgtccgaatcgatccaggaatagacctccatcttttcacggacgcgcccgccgagcagttcgtggaccggcacgccgagcgccttgcccttgatgtcccaaagcgcctgatcgattccggagagcgcgcttgtcagcaccggcccgccgcgataaaatccgccgcggtagattgtctgccagatgtcctcgacgttgcgtggatcggcgcccagcagatacggctccagttcgtggatacatgcctgtgtggtggcggcgcgtccctccacaactggctcgccccatccgatcagtccgtcgtccgtttccagccgcagcagcagccagcgaggccggatgcggaacgtttcaaccttagtcagcttcattcagagacccccgtttcatggattttgagcggcagcagcgcgccgccgttaaaggtgttttctggtacaaccggcagcagcgcgccgccgtcgacggtgatgcgcgtgccggtcatatagctgcacgcgtccgaggcgagaaaaacgaggatgtttgcgacctcctccggcgttgcaaaccgttggagcgggatgcgctcctttacctggttgatcggattgtcaggctcccagacattggtgtatccgggcgcgagcgccagcacgcggattttatgcggagccagttccatcgccgcattgcggcagaaggtatccacagcggctttgctcggcgcgtagatgtttgcctcgggaaagcatccgtccacatgattggaggcgatgttgataatgacgccggctgtaccctgttcgaccattctgcgggcggcaaactgcgtgccgaaataggcggccttccagtcggtgcgggtgatgcgctcccattgttcctcggtgacttcaagcagcgggtgaaactcgctcacgcccgcgttgttcaccatcaggtcgatcgagccgaatgcgtcgaaatacgcatcgaacaggccgcgcagcgcctggtaatcgcctacgtcggctcgaaaggcgagcgcctgcgcgcccgcttcgcgtgcgagccggcaggtgtcctccgcgcccgtccggttgttgcagtagttcacaccgacgtcgtagccgttttgcgccagtgcgatcgcgatcgcctttccgatgccgtggctcgcgccggtaatcagcgccttttttcttttcatactgattctctccttttttcaaaatccatgctttggcccgcggtacccccgaaggtgtgcggcgccacgcgctgtgggggtaagctcatgtcttaaaacctgttcaatatcttagggtgttccgaatgggcgggaattttttcgttcggcaatacaaaaaaatcgcagccaagccttggcggcttgcgagattttttaacacagaaggacggaaaaagacctgctcaggcggtgcgccaggaaatgctgaatgggttctgtggtcaaaacaaggagattttaatttgtgtgtacgttaactgaaattataacatgctttttacaacaagcaagtatttgctaaaaaattcacaaaataaacttataatttagtgataaagtgcaaattataatttggtttttgagacgtttttcacagaaagcaggagcaataaaagctgattttgttacgctaggagtttaaaaaagttataaaaagaaattgattggtataaataaacaaaaagtaataaaattttaatataaaacgatgaatatttctcaaaatattgacagggctatgcgcaaaagcctataataaagccgatgtgttaacgtaaacacaaatgcaaaaataccgtagaatgcgggaaggaggctgtaccaggatgggcaattctgtggaattcaggcatatcagcaagtttttcccaggtgtcaaggcgctggatgacatcaatttttgcgcggagagcgggcaggtctatgcgtttctcggagagaatggcgcgggcaaatccacgctgctgaaaattctaaacggcgattaccagccggactttggggaatatctgatcaacggacagccgatccatttctccactcccagggaagcgatcgcgcacggcgtgagcgtgatctatcaggagcgtcagattttgatggatatgacggtggcggagaacatctttctgggcgactggccgaaaaagaaaaacggcctggtcgatttcgctctgatgaaccggcgcaccgctgaaattgccaaacgcttcgggctgaatatcagcccggaaacaaaggtgggaagcctgagcatcgcccatcaacagatggtagagatcatgaaggccgtcagtcgcgattccaatatcatcgcgtttgacgagccgactgccagcctgagcgacaacgagatcgatatcctgttcgatatcatccgccaactgcgggcggaaggaaagatcattttctatgtctcccaccgcatgaatgaaatagcacaggttgcgcagaaggtcatcatttttaaggatggacgtcttgtcgagatcgtggatcaggcaactacccctgaggatcagatgatccgtctgatggtggggcggtcgctcggcgacatctacgacgccctgccgcgcagcgaacaccccggcgaggcgatcctcgaggtgaaggaactgtgcacgccgtatgtaagcgatatatcatttaccgcgcatcgtggcgaaatcctcggctttgccggattggtcggcgcgggccgcaccgaggtgatgcgcgcgctgttcgggcttgacccggtgtacagcggctcgatcgggctggaggggcgcgccatacagccgaaatcgcccgcacaggcgcttgcgctcggtttcgcgatggtgccggaggaccgcaagatgcagggcatcctgccaaacatctccgtgcgcggcaacataaccgtttcaatgcttaaaaagcttgtgagtccgatcggctttgtgatgaccgataaggaggagcaaatcgcccagcgggagatcgctgaactcaacatcaagactcccaattcggataagctgattgcgcagctttcgggcggcaaccagcagaaggtcatccttgcccgctggctggaaacgcacccaaaggtgctgattcttgatgagccgacaaagggcatcgatgtgggcgccaaggcggaattttacaggatcatcgccgcgtgtgcgcagcagggcatggccgtcatcgtcatctcctccgagctgcctgaggtcatcgggctttctgaccggatcattgtcatgcgagagggccggatcagcggagaggtcagccgcgctgacttcagtgaggagatcattttgaaatacgcgatggccagcgtcccgcaaaacgcggagcaataagcaggaggaacagcgagaatgaataacctgatatataaactgaaaaaaagcgactttgccgacaagatcacgctgattgtggcaatggtgcttctagtggttctgttcggcgcgctcaaccgcaactatgtcaccggcgcgaacatgatcaatatcctaatcgcctgttccctgaccgggtttgtggcgatcggtgaaacgaatctgattatcgccaaccaaaacgacctgtcggccggttcggtggccgcctgtgccggcgtgcttgccgcgatcctcgcgcgcgagggcgttccggcgattctggcgctggcgatcgcggtctgcgccggctttctggtcggagcggtcaacgcggggcttgtcaccttcctcaaattacagccctttatcgcgacgctggccaccatgtcggtggtgcgcggcatcgcttatatcctctgcaacggcaaggcggtagccatcagcgacaagacgtttattaaattcggcaattaccgcatcttcggcattctgccggtgccggtcctgcttctcctgattgccttcatcgtattcggcatcatattgagcaagacgtatttcggacgcagcatctacgtgctcggaggcaacacctacgctgcgcgcctggccggactcaacccgacacgcatcatcttcaagctgcacatcatcgaatcggggcttgccgctttcgccggcgtgctgctggccgcgcgcatgaattccgggcagccgtcggcctgcaacgggcttgagtttgacgccatcacggccgccgttctgggcggcacggccttcaccggcggcgtcggcacgatcttcggcacctttttggggatgcttgtgctccagggcttcaaaaccgggctgaacatggttggcgtgcagaccttctggcagcaggtcgcgcagggcgggttgttggtcgtggcgctggcgttcgacttttaccgcaagcatacacgtgacaagcgcgcgcttgaggaaagcatggccgcgcgcggcgcgcagctgccgaacaagaaggcgcgcgcctgatgcaaaaggatccccgcgggcggcggacgcccgcttttagctcctgtattcacagcctgtggatgcttgacaagcgaggaatttttccagccggtcaaggcgcatttttgcaggcgggctgtcgcccggcaaaaaaatttaacgccaagcggggaaaaaagcccgcatggacagtgcctaacggcttcgaatacaggttcttacacagaaactgatcagcaaaggagaagaatcatgaaaaaatcatttctgaaaacgcttgcgacagggctttccgtagcgatgctggcggcgatgaccgcctgcggcggctccacgacggcctcgtcctccgcggaatcgcaggccgcgccggcagacggcgcttccgcaccggcgcagagcgcgcccgccgattccgtgtccacaggcgacaaaacgattgtcggcatctacaagatgggtacggcgacctggtttatccaggagggagcggcctcccaaaaggtggttgaggacgccggctacacctggaagtttatggactgcaaccagaatgccgcgacgtatatggacctgctcaacacggtgatcgcggataaggtcgacggcgtgctcgtctgcctgccggaccagaacctgagccagacgaccgttgacatgctcaccgaggcggggattcccgtgatcgcggtggatgacgcgcttgaaactgaagacggcaccaagctggccccgtgggtcggtatcgacggcttcagcatcggcaaggccgccggcgagtggggcgtcaactatatcaaggagaacaacctcgccgatgacgagagcttcggcatcctgctgatgacggccgacaccgtttcctcctgcgtgccgcgcaccgagggcgagctggcggcgctctccgaaggcctgcctgatttccctgaatcccgtatcttccgcgccgactgcgacacctccgccgaggacggcaaccaggccgccaacgcggtgatcaccggtcatcctgagatcaaaaaatggctggtgctcggcgtttccgacgagagcagccagggcgccgcgcgcgccatcgaatcagccggactcggcgctgattcgatggtcatgggcttgggcgcgtacctgtgcccggacgaatttgaaaaccccgactcgtgtttccgtgccgcggcttacttctcggcgcgcgacattggcggcaccgccgcgcaggaaatgatcgactatcttgagaacgggacagaaattcccgagacatacgctgtcggcgcgaccatcgttgaatacggcgacgatctggcaagcatcatgccggaatatgtaaacggataatcccgcccggccggcgatagaggttccaaagcctgttcaggtgttcgccttcctgaatgaaacctgttggcagggggattttgaataggctttcataaggccgcggagcataaaaccctgctgcgcggccctctttttggatgaaattgccctgccggataaaaaagagagtgataacatgcgaaaaattcgatttgaaaccatggtcccggcagaactgctcgaggcggtaaacggccggagcctggtctatcagccggtcggcagcatggagtggcacgggccgcacatgggcatggggatggacacaataaatgcccatgcggtcgcgctggaggcggcccgccgtaccggcggcgtcgtgatgccgccattgtatatcggcaccgaaacgccgcgcagccccgaaacgctcagaaagctcggcttttcgggcgatgaacgggtcgttgggatggattttccccaaaacagcgtagcaagcttttattggccgcccgatttattcgaggcgatcatccgccggcagacgcagatgctgcttgagatgggattttcccaggtagtgctgctcaacggccacggggcggatgcgcaggttgagattctggaacgcgtcagcagggagctgtcggtgcagagcgggcgatgcgtgatgaccataatggccctgttcgacggctgcggcgctgggttgggacacgcggggctggcggagacggcgatcttcgcccacctctgcccggaagctgtcgaattggaccgcctgccgccaaagccgcagaagctttacaatacacggtgggggattgcggacagcgagacgttccaaaaaggcccgaacgaggatttcagcgtgcggtacgatccgcgagacgccacccccgatttgggcgcgcagattgtggaatatacggtgaatcagtgtgtgcgtctggtcgagcaggcgcacgatgggaaagtacccgcgggaaactgaaggggaggtcccggacgcggcgcggccgcggaaaattttccaggaggatatggatgcgatgatgagacagattaccgaaggcgtagccgtctggcgggaaaatgtagtgattccgacctatccggtcggcaagcccgataaaaacccgatgtttctggaaaagcgggtgtatcagggcagcagcggccgggtgtacccgcacagtgtcattgataaaatttatgatgaaaaggtggatcgcacctaccaggcgctctgcctggaaaataaatatctgtttgtgatggtcctgcccgaattgggcggcaggatccagcgcgcgtatgacaaaacaaacggctacgattttgtttattataaccatgtgatcaagcccgcgctcgtcgggctgaccgggccgtggatcagcggcggcatcgaattcaactggccgcagcaccaccgcccgagcacctttgacccggtcgactgcacaatccgcgagaacccggacggaagctgcaccgtcgtggtcggagaaacggaaaatatgttccgcacgcgcggcacggcgtccttcaccattttccccgacaaagcgtacatcaaaatcgacgcgcagatctacaacagcaccagtctgccgcaaacatttctctggtgggcaaacccggccgtgccggtcaacgacgacacgcagtcggtctttccgccagacgtacatgcggtgatggaccatggcaagcgcgatgtctcacgcttcccgattgcgacgggcgtttattacaagcaggattactccgcgggcgtcgatatctcccgctataaaaatatcccggtgccgacctcctatatggcgtatcattcggattacgactttgtgggcggctacgaccacggacggcgcgccggcatcctgcatgtggcggatcaccatgttgcgcccggcaagaaacagtggacctggggctgcggcgactttgggcaggcatgggatcgcaacctgacggatgaggacggcccgtatgtcgaattgatgacagggtgctttaccgataaccagccggatttcacgtggcttgcgccgtatgaggaaaagaccttcacccagtatttcatgccctacaaggaagtgggaatgatcaaatgcgcgtcggtcgacgtggctgtgcgtctcgagctggacgggcagacggctgatctggccgtatacgcaagcggcgagtttgccggcgcgcgggtcgcgcttgaaaaggacggccaaacgctctgggagcggacgctcgacctctccccggtcagtatgctgacggagcttgtcccggacgcgggcggcgatccgaccgctttgacgctgcgggtgtccgacgcgcaggggcgcctgctggtgagctatacgcccgagccggaacgcatcgaaaagacgcccgagccggccaaggcggctcccgacccggcggacgcgcgcaccaatgaggatctgttcctttacgggcagcatatcgagcagtaccgccacgcgacctatctgccggaggattattatctcgaagggctgcggcgcgacccgaccgacgcgcgcatcaacaacgcctatggcctgctgatgatgcggcgcggccgctttgagcaggcgcagcgccattttcgcgccgccatcgccaagtatacccgctccaacccaaatccctacgacagcgagccgtattataacctcggcgtctgcctgaaattgacagggcgccttgacgaggcgtatgatgcgttctacaaagcgacctggagcggcgcgtggcaggcccctgcgttttacgccatggcctgcgtcaaagcggcgcagggggattttgatctggcgctttcccatgtggagcgcagcctggtgcagggcgcgcacaacctaaaggcgcgcgcgctcaaggcggcgctgctgcgccgcctcgggcaggaacaggccgcgctggccctggcgcgggagagtctggcgatcgacccgatcgactgcgcggcgcgctacgaattgggcggcgaaacacgcgaacggctgtttgcgtcgatctgtgaaaatcccaactggtgcgtcgagctggcgctcacctacgccgacgcggggctttatgccgaggcggaggaggttttgacggcggcgtccgacgccggccagcattatccgctggtgcattattatttggccgatttctgcgagcggcagggaaaacaggacgcggccgcgcgccagcgcacggccgcctcgtctgcgccgtccgattactgcttcccgcaccgcctggaggatctgcttgtgctcaaccgggcacttgagaaaaatccggacgacgccaagggttggtattacctcggaaatctttggtacgacaagcggcaatatgcgcaggcaattgagtgttgggaacattcccgcgcgctggatggccgtttcccgaccgtgcaccgcaacctcgcgcttgcgtactttaataaatgcggccgcccggatgacgcgcttgacgagatggaacaggcattcgccctcgacaggacggacgcgcgcgtgctgatggaattggatcaactgcgcaaaaaacgcgggatgagtgctcccgagcgcctcaaggcgctggaggaaaaccgggaatgcgttttacagcgggatgacctgtatttggaatacatcaccctgtataatgcgcttgggcggcatgaacaggcgctcgaaatgctcctgggccgacagttccatccgtgggagggcggcgaaggcaaggtacccgcccagtacaggctggcgctgacggagcttgcaaagcgggcgctggcggccggcgacgcccaaaaggcggctggactgctgcgccgggcgacggtttatccgcacagcctgggcgaggggaaacttgccggcgcgcaggaaaacgacatctactattatctggggctggccgaacgcaggctcggcaacgcgcaggaatctgaacgctgcctgaaaaaagcgtgcgttggacttggcgaaccggccgggatgatgtactataacgatcagccgccggagatgattttctatcaaggcctggcgcatcgggcgcttggcgacgagcatggggcgcttggacgcttcaacaagctggtcgactatgcggaacagcatttgcaggaccatgtcaagatcgattatttcgcggtgtcgctgcccgacctgcaaattttcgaggaggacctcgatgtgcgcaaccgcgtgcactgcctgttcatgcgcggcctggggctgcttggcaaaggggatgcggcgcgcgccgacgcctgcttcgccgaagcggagcggctggatgcaaaccatatgggcgtgcggatccaccgcggcatgaagccggatttttaatcagggaggaggcgccggatgcggcggatcaattttatgggcgccgacggatgggcgcttgagaacgaggcgctttcagccgttgttctgccggcgcatggcggcaaggtcgcctcgataatttacaggccgcgggggtttgagctgctttttcaaaacccaaagggcgttttccgccgtgccgggcgcggagacgatttctccatgttcgaggcgtgcggatttgacgaggcgtttccgaccgtggacgcctgcgtgttcgagacggccggcgaaacgctttcctatcctgatcatggggagctgtggtcggcggcgttcgaaccgaagatggacggcggcggcatcctactttcctatcacagcccggtcttgggctaccgctatgagaagcgtttttccctggaggatgagcggctggtctgccgctaccggattgaaaacccaacgggccgcgacctgcctgcgctgtgggtctgccatctgctggtgcggtgcgagccggatatgcgcctgctgctgccgcccggtgtgatgcaggtacagaatgtcttttccagcgactggctggggcagcggcgcgcgctgctgtcttggccgctggccgagggaccgcgcggccaggtcgacctgtcgcggatgccgccggatggacagctcaagtattatgtccgcggccgtgtgcgcgcgggccaatgcggctatgaatatccccggtcgggggtgcgcgcgctgctttgctacgatccggataagctgccatatctcggcttttgggccacggccggcgggtaccgcggggatgtcaactgcgcgcttgaaccggccaacggttattttgacaacatcccgaccgcgcaatcgtttggcgcctgcccggtcctgcgggcgggagaaacgtgggatttttccctcgcggtcgccgtctctgagatcatgcgcgaataaaggccgcgtccggcattcacaattcacgaaaagcgccgtcatgcggatttgccgcatgacggcgctttacatgccgtctgtagaaatattcggtttacccctgcaaaggcgcttcgccgggcatgccgcccgccatccggccgccgtcccggtccggaccgcgttctccggacatgccggttacctccgacccgtcgctggaaatgcgggtgagctgttcggaaagcgtgacgcttgtaagcgtttcgccgtcaacgcagagggtatacgtttcgccctgcgtaagcgccggcgcggaaagcacgagcgtctggaagggctgcgccggcacggcggacaggatggtttccccggcgctgtcgagcagggtgatttcggcacccggcggctgtgatccggtgaagtacaccataagaacagcttgcgtaccgtcctgcggcgcctgcgccatgcctgcggagccggaagcgatgagcgtgccgccgttcatttctgcgcttccatcgaaatcaagcgcactgtccgcgccggaggtcgggccgtttataacggttgtcccgccatccaggtagagattgccgttggaatcaagcccgtcgccgtaggattgaactgtaagcgtaccgccggtgatgcggatatagtaggcgtcgcgtgcggcgaagcggtcctgcccgaagccggcgccaatgccgccatcgctgccgccggctgcattgacgccgtcatcgcttgcagtcaggtcgatttctccgccattgatgtcaaccgtggcgctctcaagcccctcatagcaggtatcgatttggataacgccgtcgtcaataacgagagcgccatccgcatggaaagcgtcgtcgccggtcgagatcgcaaaggttccgcccgagacggtcaggctcccgttggaatggaccgcatcgtccgcgctgtcaatggtaaatgtaccgccgctgaccgtcagggaggtcaccgccttcaagcccttcatactgttgctggtatccgattcggcagcggctgtcgaatcgagtatggccgcctgattggaaggagccgtttcgctgtcagcaggcggcatgctatcagacggcgccggatcggcagaggctatcgagccgtcggaggaggccgcgccgctctggacagtcggcgcgctgccaggggatatcgtttcgctgtttgggggtgcctgcatgccttccggcggcgtcataccgccagcgtagaatccacccgccatacctgcgccggggcggccgccgccgaagtcctgcgttttccgtgccggcgcgttggcgctgccgccgcccgttacgatcgtataagtcccgccggtgatggtcatgtcggtttccgcctggatgccgtcattgcccgcagtgatctggtagactccgccggacagggtgatccagcctttttcagcgtcctcgtcgttgttcgatttgatgccgtcgccttgggcgtcgattgtgaaattaccatcggtgatggtgacggaatcacgtccgcgcaggccgtcgtttgccgctgtgacaatgagcgtaccgctttcgatcagcaggttgtccttgctgccgatcgcgttgttgaagctgccggttacggtcagcgtgccgctgccggcaattgtcaggtcatccttagcgaagatggccgcgtccggttcgtcgccgccgtccggataggcgtactgcgctgcgtcggatacgctgttttgtgtgccgtcctgaagcaggagcgttgttgtcccggcctgcttggcatagatgcccgcgctgttggagcaggagatattcgcgttatcaagcaccagtgtgaccgcgtcgtccttaccggcgtcgatcacgatctgcccgtcgtcaagcgtgcctgtaatacggtaggttcctgcatccgaaattgtgatgacggtgccttgcacagcggctccttttccctgaacagaggcgctgccgccgttcagggtgatggtggctgccgcggcggccgtctgctccgcattgacatcgggagcggccgaagcgcagccagtcagggcggtacacacagcaatcgatccggccaacgctgcaaatatatggttgtgtttcataaatgcctccttacaattcgtcacgggcggaggaaatccgcccgcaggtgatgtttaaatttccattgcggcagcgcagttcatcgatcaatgctttgctgatgccgtcgcctttcagttcaacgagatagcacagctcgtacaggcttcccatattggtggtgcgcacgcgctccagctcggcgcgtgtggtatattttaggagcaagtcgtcaaaaatcccctcataatccaacccttcgggtatggtgattttcagctcccgctgcgtacgcggcgcgctgccgaagtccgctgcattcaaaaggagcatcacggcgccgaccatcacaagaaacaacgccgcatagccgagatagcccataccgcaggcaaggccggccgccatcgcgaagaaaatgctcccgatttcccgcgcgctgcccggcaccgaacggaaccggacaaggctgaacgaccctgccacagccacgcccgcgccgatgttgccgttgacgagcatgatgacgatctgcaccatggccggcagcagagcgagcgtcaccgcgaagcttttggtacagccgccgccttggcgcagatgcagcagggcgatgcacacgcccatgacaagcgccgcggcggtgcaaagcatgacgccgggaacggtcacgccgttttgcaggacgctttgaaagagaagatcaggcacagccaagccctcccttccatacagcttcacgcgacagataccgccgataacagaagccgtattttgaaaaggagactggatagacggccaggctgtccagcaggcgcgccagccagagcggcatgacgcctggaagcttcagctccatcagcacgtacccatcgccgcacagcggcgcgccccaatcgcctttttccagttcaagcgcccggccgcgccaacgcaggtccgtgtcaaacgtggcccgcagccccggctcgccgggggcataaagcgcgatgcggtcataagccagataaacctttggctcgggctggtaaaattgcagcgcccaagcgatttccctgagaatctgcgttccgtccgcacgcttcgcgccggacaggatggcttgcgcctcgtccggtgcgagcgcggcgcggcgcttatagacgacgccccggtatttctttttcaattccaaaaacacctggctttgcgcgttgggaacgccatagctgcgcaggcgcagcttttccttataaataggcttttcgagcgatgtgcggatcaaatgataatcgggcgtatcgtaatatatattacagatcgtataccgcccataatcatcttcgcgcatcctgtcaagaagcagcccgcgcagcacatggtactgatcgggactgagccaatattttttctcatagcgtgcaaaaacttcctgtgccatgagcgcacctccattttgttgataagggcatcatactgcggtttgctgaaaatagtctgaaaaaagcttttcagactattttcagctttgccatttatgatgaatgcgtgaagggacgctttgtggtacaatattcgcaagatgattatcataccatacgacgcccgacggctcgccgcatacgcggcaatcgcgcacagcttatatcttcatttgacgcagcttgcagtgcgtcactgcgttttggagcgcgcatcataaaagcagacggatggaaaggatggcaaaagatgcgggtattgattgtggaggatgaacgaaggctggcagacgcgctctgccagatcatgcgtgaacaaaaatacggtgtcgacgctgtttacgacggtcgtgacgggcttgactacgcgatgagcggacagtacgacgtggtggtgctcgatgtgatgctgccggaacgctccggctttgaggtggtccgggcgctgcgtgcgcaaaacaacgctgtgccggtgctgctgctgacggcacgcgacgaaatatcggacaaggtgacggggcttgactgcggcgcggacgattatatgaccaagccgttttccccggaggagctgctcgcgcgggtgcgggcgctgtcacgccggcagggggaggtgcagcatgaggagcttcggtatgcggatctgtgcctgaatctttccacgcgcactctttcgcgcggtgaaaagtcggtttccctcggctataaggagtttgaggttttgcacattttgctctccaatccgcgtgcgatcaccccgaaggaggagctgataacccgcgtatggggcgccgactccgacgcggaggacaacaacgtggaagcgtatatctcatttttgcgcaagaaattcttttatcttggctcgcagacggcgattagcgcagtgcgcaaggtaggctaccggctggaggcgggcgtatgatccaaaagctgcgtaaaaaatttgtgctggtcaatatgctgcttgtcagcgttgtattgctggtggtgtttggcgcggtctgtttttccagttatcaccgcctgcggcgcggctgtctcgatgcactgcaccaggcaatcagccggccgatggacgataaaccgccgcgtcttgagcttggggaggttaagcgcccgccgcagtggcaggccgaaatggcgccggtatttgtggtggagctgtccggcgacggttcggttgcgtttgtcaggggacagaatatcgcagtcgataccgacggcatggagacgctggtaaatacggcgctggcgcaggggcagaattttgggctgctgcacggctatgggctgcgttacctggtgtcggacggccgggacgggccgggcacgcggatcgccttcgcggatatcagcggccagcgcgctgcaatggtaagcttggcggcgacgtcgctggtggtggggctttgcgcgctcgcggcattttttgtaatcagcttgtacctggctaaatgggcgctgcgtccggtggaacgcgcctggcgtcagcagcagcagttcgtcgcggacgcgtcccacgaactgaaaacgccgctgacggtgattttagctaatacggaaattttgctctcccaatccgcgggtatgttgccggagcagagaaaatgggccgagagcagccgcgaggaggcgcgccgtatgaagggattgatcgacgacctgttgtttcttgcgcggtctgacgcatcaaaggcagctccggttttttccgtgtttgatctgagcgacgcggtgtggagcgcggcgctgccgtttgaggcggtcgcgttcgaacagggtgtgcaactttgcacacagatcgacccggggctgcaatatttagggcatgaggggcagatcagacagcttgcagcaattctgatcgacaatgcatgtaagtacgccggaaggggcggtacggtgcttgtccgtttgtaccgagagggggagacggcaacgctcatggtgcagaattccggcgctccgatccccaagcaggcgctgccgcgcctgtttgaacgattttaccgcgcggattcctcacgggcgcgcgcatccggcggatatgggctggggcttgcgatcgcgcaggcgattgcgcaggcgcataaagggaagatatctgtggaaagcggcgagccgtatgggacgcgcttcaccgtgaggctctataaggcgcagcagaacacataagaacgaaaaaagccgccgcctgctatagcgggcggcggcttttatgcccccttgtttattgcgcgatccagtgcggcgcggacgaaggcgcggaaaagcgggtgcgcgcggttggggcggcttttgaattcaggatggtactgcacgcccagatagaacggatggccgggaagctcgactgcttcaacaagacgtttgtccggcgatgtgccgcagatacaaagccccccgctttccaactgtggacggaatgtattgttgaattcatagcgatgccggtggcgttcgcgcacttcggcgcagccatagcagcggtcgagcagggtgccgggcaggacggcgcagggatatgcgcccagacgcatcgtcgcgcccttggagcgcacatccttttgatcgggcatcaggtcgatcaccggatgtccagatgtgctgcgaaactcaccggagtcggcgtctgcccagcctataacgccgcgtgcaaattcgatcacggcgacctgcatgcccaggcagatgccgaaatacggcatgccgctttcacgggaaaagtgggcggcggcgatcattccctcgatgccgcggccgccaaagcctcccggcatgatgacgccgtcggcctcggctagacgcgccgccgtgtttgatgcggccagctcctcggaatcgacccagtcgatttcaatcctggcgccgttttcccagccggcgtggcgcagcgcctctgcaacagaaagataggcgtcgtgcagcttgacgtatttgcccacgagcgcgatgcgcaccgtttcactgcatttggcctggcggtcgagcattgcgctccattcgcgcagatcgggcgcggggcagtcgagcgccagctcgcggcagacaaccctggcaaggccgttctgctccagcatcaggggcgcctggtagagcacaggcagcgtgcgattttcgatcacgcagtcctccttgacattacaaaacagtgcgatttttttgaggacctccggatcgatcggcctgtcgcagcgtggtacgatgatatccggcatgatgccgagcgattgcagctcgcgcacggagtgctgcgttggctttgatttctgctcgcccgaggattggatatacgggacgagcgtaacatgcaaaaacaggcggttgcccgcgccggcctcgtggcctatctggcggatcgcctccaaaaaaggctgcgattcaatgtcgccggtggtgccgccaatctcggtgatcacaatatccgcgccgctgtgctcgcctgccgcgtagataaacgatttgatttctccagtgatgtgtgggatcacctgcactgtctggcccagatattcgccgcggcgttccttttgcagcacattccagtagaccttgccggtcgtaaggttcgaaaagcggttgaggtcctcgtcgatgaatcgttcatagtgcccgaggtcaagatcggtttcaacgccgtcctcggtgacatacacctcaccgtgctggtagggactcatcgtgccggggtcgacgttgatatacggatcaagcttctgcgcgacaacccggtatccgcgcgctttgagcagacgtccgagcgaagcggctgtaatgcccttgccaagtcccgatacgacgccgcctgttacgaagatatactttgtctgtttcaattgaatcgctccccagaacagacgcgtggcatcgccgcgcgtcctcctttttatcagatatcagttttcgtaggtgcggatgatttccccggcaatttcacgctttgtcatacgcagatccatcgcttgctgttcaatgtagcggtgcgcctgcggctcggtcatgccgagcgtctcgatcaacaggcatttagcccggtcgatcagccgcaaatcctgcaactggcggtgcaggcgggcattttcttccagcagggaagccagccggttctgtgccgccgcgataaaacgcagtgcctggtcgaacagacggcggtcgatcggtttttcgattacgaaaacacccgcatcgcaaaccttctgcgctgcttcggcggccatgtcggcgcgtgcgacaagcaatatccccgcgccagtcgactggctgacgcgccgcgcaagctcgcaaccgaattcatcgggaagcggcgcgttgataacgaccagatcgtatgcgccgtcgagcgtcaggcggcgtgcttcgccgccgttttttgccagcgccggggcggcgggaaagtagcccttcagcagcgcacagagatatgctgtccccttttcggtgctcgatacaagcaggacacgctccatcagctcaccccttttcgttttcaaagcggacgcgggatcagacgcggtcaaaataaagcttcagctctgtctggtggcggttttcggtgcgttccattcgttcagcttcacgccgcttctgttcgcagtagcggcgcagaagcgccgctggaagatgccgccggttaaagtccgaggcggcggcacattccgcagcttctcccaggccgcgcggcagaagcgggtaagcatttgatggctcggcatcgtacaggttgatgtccacaggcggcgtcagcggcagcgcatcggcgattccatccagcccggcatgaatgatcagtgccagggccagatatggattgcaggcagggtcgggcgaacgcagctcgatacggctgtattcgccgcgcgccgccggtatgcgaataagctgcgaacggttgccgcgcgaccaggtagcatatttgggcgcttcgaatgcgccgaagcgtgcgtaggaattggtcagcgggtttaaaaaggcggtgatatcgcacgcatgggcaagcaggccggccatgaaatgatccatttcaggcgcgccgtgagcaaataggttctttccgtcttgaaagagagacagattgatatgcaggccgctgccgctgtactcgagaaatggcttaggaagaaatgacgcatataagccgctttgggccgcgatcgatttgacagccgccttgaagccgaggagatggtcagcggctgtgagcgcacccgtatagcggaaatcaacttcgttctggccggggccctgctcatgatgggagctttccgggcgcataccgagcgattcgagtgtcaggcagatttcgcgccggatgttttcgccgcggtcgagcggtgcgatgtcgcagtagccgccgcggtcgtgcgggatcatggtaggacggtcgtattcgtccgtttcgaacaggtaaaattcacattccgcacccacctggacactgtagcccatttcggcggcacggcgcgccgcctgcttgagcagggcgcgcgcgtctgcgtcatacggcgcgccgtccgggcggacaataccgcagaacatgcgcgccacgcgtccctgtgccggacgccagggcaggacggacagcgtggctggatcggggaccaaaaacaggtcggaatcctcgacgcccgcgaagccgccggccgccgacgcgtcgaaggagatgccctcctcaaatgcgcgctgcagctcgctggactggatggcgatgtttttttggaaaccggacagatcacagaaggccagacggataaatttgacatcgttttccgcgacaaactgcaaaacgtcctgactggtctggttcatatgcatgaccacgcgcccgccgcgggcgcttcctttctgttgtggtttggggtgctgcttacaggactgtgtaaagctggcggtatggattttttgtatcgggggtgagcagtgtaaagggctggccgagcagcgcgtccacgctgccgccaaaggctgtgcagaaggcttcgagcgccggacggatggcttcaagcgcctggggcgcggctatttgtgcgagcacctgctttggcaggtcgagaccggtgtgcaccccgcgcagatagatccgtccgccgtgcatacccgtgccgcagaagtagcctacggggctttttcgttcttcgaggtttaaaacgatgatttcgccgccggcctggtattcgccgagaaagctgcccgccgcgccgccgatgacaagctgcgggatcttatcgcggtaggccttcatatggatgccggcgcggtagccggcgtcgccctgaatcagaatccgtccgccgcgcatcgcatagcccgcggcgtcgccgcaggagccgtgcacgatgatgctgccggcgttcattgtatcgcccacggcgtcctgggcgttgccgaacacctcgatctcgctgccgtcgagatatgcgccgagcgcgttgcccggcgtgccgtgtatcacaatacgccggccgcttgatgcgtccccgagataccgctggccgagcacatgcgtgaggatgatttccggcgcctgcgcggcggcgagcgcgtcgttgagcgccctgaagtcaagtccgcgcgcgtcgatagacgctgcgcataaagtttgaacggtcatcttgtcaacccctttattcgccggcgtgcctgacgccgaggatggaaagttctttttcgttcagtccgacgccgcgcagcatcaaacggttgccgcgcagcgcctcgatcgagttgatgcccatgccgcccatcatctccttgatttcatgtttccatgcggtgacaaggttgaccagacggcgcacgccgtcctccgggtcgagccgggcggtcagttcgggacgctgggtcgcgatgccccaattgcacaggcccttctggcaggagcggcacagatggcagccaagcgccatcagcgcggccgtgccgatatagactgcgtccgcgccaagcgcgaccgctttgacgacatcggcgctcgaacggatactgccgcccgctatgatagacacctcgtcgcggatacattcatcgcgcaggcgctggtcgacagcggcgagcgccagctcgatggggatccccacattgtcacggatgcgcgcgggcgcggcgccggtgccgcctgaaaaaccgtcgatcgcgatgatatccgcgccgctgcgcgcaatgcccgaggcgatcgccgcaacgttgtggaccgccgcgattttaacgatcaccggctttttgcgcccggtcgcctccttgagcgaatcaacaagctgacgcaggtcctcaatggaataaatatcgtggtgcggcgcgggggaaatggcgtcggagccttcggggatcatgcgtgtgcgcgaaatatcaccgatgatcttcgcgcctggaagatgcccgccgatgccgggctttgcgccctgtcccattttgatctcaacggccgcgccggcgtttaaatagtcgacatggacgccgaaccgccccgaagccacctggacgatcgtattttctccatacgcataaaaatcctcgtgcaggccgccctcgcctgtattgtacagtatacccaattgccgcgccgcacgggccaggcattcgtgcgcgttgtagctgatggagccgtaggacatggcggagaacagaaccggcacgtcgagcgtcaattgcggcggaaggttgtcgaccaacaggccgtttccatcgcgctcaatacggcccggctttttgccgaggaacacgcgtgtttccataggctcgcgcagcgggtcgatggagggattcgtcacctgtgaggcattgatgagaagccggtcccagtatacgggcaggggctttgggctgcccatcgaagaaagcagcacgccgcccgtctcggcctggcggtagatttcgttgatcgcatcgtttgaccagttcgtattctcgcggtaggtgtggctgcttttcacaatgcgaagcgcgtgcgtcgggcagatggccacgcaccgctggcagttgacgcatttggcgttgtcggccgtcatgcgcttttgccggtcattgaagccgtgcgcgccattggcgcattcgcgttcgcacaggcggcagcgcgtgcaggccgcgtcgtcgcggacaagctcgaattcaggagcgatatatcccggaatcatgttgcgtccactccttccataagcctgacaatgaccggttcgccgccgcgcggcgcccagatgcgctcggggttcggttcgacggcgcggatggcgctttcctcgctggcgacataaaaacatccgcccttttccgccgcgaccatcgaacgcagcttgagccggtcgttgagcgccatcatgccgccggtgaagccgagcaggattgaaaacggaccggtgacaagcaggctggagaatgcgctgcgcagataggtgagctgctcgcgctgcggcgacggcttttttgcgatagtcgaccagaacggcgcggcgatgacgctggccgtctcctccagtgtcaggccgcggcggcggttgagaaagtctataatataagtgatgacctcggtgtcggtcagcagcgtgcagtggtagccgtgcatctcgatcgcgcggcggttggcgtcgtaggaggaaatctccccgttgtggacgatggaataatcgccgagcgcaaacggatgcgcgccgccccaccagccgggggtattcgtcgggtaacggccgtgggctgtccaggagtagccggcatagtcctccaggcggtagaaacggccgacgtcctcgggataaccgacagccttgaaaacgcccatgttcttgccgctggagaatatgtaggcgcccttaagccgcgcgttgatgcggatgacgcagcgcatggtaaattcgtgctcgtcaagctggctggccgcgagcctggtaggcagcggcgtgacaaaataacgccagatcagcggctcgtcggtgatggagggaagcttgcgcgtggggatacgcgagagattgatgatatcgaagtgacgttccagaaacttttcgcagtccgccttgacatcgctgttgtcataaaagacatgcagcgcgtaataatcacggtactcgggatagatgccgtaggcggcaaagccgccgcccaggccgttggagcggtcgtgcatcagcgcgatggaacggatgatggcttcaccgctcatacggcggccgtcccgcgcgaagatgccggagatcgcgcagcccgaaggaatgcgcatctggccttctttaagcatgtcggaacctccagggggccgtagacggcccattttttcccgcggcgcctaagcgccgcaaaaaggcgctcataaaggggaaaagtcctctttgcccatcccctttatgaacgcctttgttcaatggaattattataaaaaaatgcaggaaggttgtcaattaactttcaaaatttctctgttttacaacctgaaaagcggttgatacggctttatttcgtgcgtatttcataaaatttgaaacattttctttttttcctgcaaaaaagaggttgacagatcacctgatcggcactataatgcagccatagcagcaaaggcgctgcgggacagtggttcccgcggcgcttttttctttaaattgccgaaaggacttgattgttatgagcagaaccgttattcccgccggctatcgtcccgccgagggtctgggactatacgacacgcaggcggccatcaacgagattcacagccgctttgcggcgcatctgtgcggcgcgctgcacctgacgcgcgcctctgcaccgctgttcgtcgatccgaaatcagggctgaacgacgatctcaacggcgttgagcgtccagtttcgttcgacatcaaggagacaggcaagattgcacaggtcgtccactctctggcgaaatggaagcgcatggcgctttaccgctacggattccagcccgggttcgggctgtataccgaaatgaacgctatccgccgcgacgaggagctggataacctgcattcgatctatgtcgatcagtgggattgggaaaaggtgatcgaccgcgaacaccgcacgcaggtttatttaaaggcgacggtgcaaaagattgtgggcgcgatctgcgacacgcttgacgagctgaaggaagattacccgtcgctgcgcaccgagctttcacgcgatgtcagttttgtgaccacgcaggaattggaggatctttatccaggtttttccccgaaggaacgcgaaaacgcttatttaaaagagcaccgcacggcctttgtcatgcagatcggcgatttgctcaaatctgggcttaaacacgacggccgcgcgcccgactatgacgactggaagctcaatggcgatattgtgttctggagcgacgtgctgggatgtgcatttgaggtttcgtcgatgggcatccgcgtggacgcgcagtcgatggacgaacagctttccaaggcgtgcgccgacgaacggcgcgggctgccatttcacaggatggtgatggacggcacgctcccgctgacgatgggcggcgggattggccagtcgaggctgtcgatgctgctgcttggcaaggcgcatatcggcgaggtgcaggcatcgctttgggacgatgatacggtcacggcatgcgaacgggcaggtgtcacgctgctgtaatcattttcgattaagtcagggaggcggagatataatgtatgacaatcataatggcaatttgaaccgtgttccggatctgttcgggagcatggtgttcggcgacaaggccatgcgcgagcgtctgccaaaggaggtttaccgcgcgctgcgcaagacgattgaaaacggaaagagccttgataaaagcattgcagacacagtggccaatgcgatgaaggattgggcggccgaacggggcgcgacgcattttacacactggttccagccgatgacggggatcacggctgaaaagcacgacagctttatttctccggagggcgacgggcggatcattatggagttttccgggaaagaacttgtcaagggcgaaccggacgcgtcgagctttccgtccggtggtctgcgcgcgacctttgaggcgcgcggctataccgcgtgggacccgtcgtcctatgcgttcatcaaggatcacacgctgtgcattccgacggttttttattcctatacgggcgttgcgctcgataaaaaaacgccgctcctgcgctcgatggaggcccttaacaaacaggccctgcgcatcctgcgtctgtttggaaacggggacgtcacacatgtcaatacgacggttggaccggaacaggaatactttcttgttgaccgcgagcagtaccgcaggcgcgaggacctgattctctgcggacgtacgctgttcggcgcaaagccgccgaaggggcaggagctggaggaccattatttcggctcgatcaaaccgcgtgtcaccgcctttatggaggagctggacgaggagctgtggaagcttggcgtatttgccaagacggagcacaatgaggttgcgccggcacagcatgagctggcgccgatcttcacaaacacaaacctggcgtccgatcacaaccagttgatgatggagctgatgaagcgcatcgccgagcgccacggcatggcgtgcctgctgcatgaaaagccgtttgccggcgtcaatggaagcggcaagcacaacaactggtcgatctgcacaaacacgggcgtcaatctgttggagccgggcgattcgccgcaggaaaacgcacagtttctgctgtttctgaccgcggtgattaaggcggtggatgaataccaggatctattgcgcgtatccgttgccagcgcgggaaacgaccaccgccttggcgcgaacgaggcgccgccggccatcgtttcaatgtttttgggcgacgagctgaccggtatccttgaggcaatcgagcatgaaacgccgtacagcccgcgtgaaacagaggtcatgaaggtcggcgtgcacatcctgccgcgtttcccgaaggataccacggaccgcaaccgcacgtcgccgttcgcattcaccggcaacaaatttgaattccgcatgctcggttcggcattttccatctccgggccgaatgtggtgctcaatacgattgtagcggaggagctggcgcagtttgccgacgcgctggagggaacggccgattttaacagcgatctcaacgcgctgatccgcaaaacactcacagaccataagcgcattatttttaatggcaataactattctgatgaatgggtggctgaggccgaacgccgcggattgtcaaaccttaagacaacggttgacgcgctgccgagctttatcgcgcccaagagcatcgcgctgtttacgcgccacaagattttcacagaacaggagatgcgctcccgttatgaaatcctgttggaaagttactgcaagacactcaatatcgaggcgctgacgatggccgacatggtcaataaacaaatcctgccggctgtcatgaagtatacaaaccgcctggtccgcgcggcgcttgacaaacgcgccttgtgcgacagtatgccggctgaaccggaacagccgcttgcggaaaaactagcggggctgtccggctgcctttaccgcaagacgcgcaagctcgaatcggagcttatgcaggctccggagcaggcggatatcaaagcgcaggccgattattataaagatatcatcctgccgtccatgcaggaactgcgcgagacggccgacgagcttgaaacgctcacggcgaaggactgctggccgtatccgagctacagcgagctgctgtatccggtggactgaaccgcgaccgcttctttgctccgctatatagaaagaagcaatgccgccaggcccgattgtgcgggcctggcggcattgctttttgtctgccggtttgaacgcaggaaggtatcagccgacatcatagagacgcttctccagccaggcgtgcagcgcctgacggctctgttcatcaagtgcggcgcgcggtgcacgcacagtgggcgccgcaacgcagcggggcgaagacgaagcatttgttcccgccgccgcagactcgtcaggcgcacatcgaccggacatatgttgggcacagtgcagagccgccgcagacgcagggacgggctgctcgacgatgcgggaaggccgctcgttggcctcgcgctcattgacggcgaccggatcgaggttatacatgtggtcgtgctcgatatggtagacctcatgctgcagcgctgcttcctggacctcgggtggcagggcggcgttgatatagactgaaaacgtgccgtcagggttcggcgtcgtgacgccgcgcaccgtgagcggcaggttatgcaggcggcggacgaaaatggttccgtcggtcatgaacgtccttcttcctctttctttaaggcttcaatgatagcgaccgcccgcatgacatcctcgcgggtggcatttttgcttacggagaacagcatgcgcagttcggagcggtttttcagctcctcgagatactgcgcgaggccatcgtcatccgtctgtgtgtcaggctttggatattttggaacatcgtaccccatcagccactgtggatcgacgccaaagcggacggcaagtgattggaccgtggggattttgggcgccatcagaccgttggcatagcggctgattgtgccgggcgacatggacagcgcagcggcgatggaataggtcgtttcgccggatgtgcgcagaagctcggaaaaccgctggccgaacagggctttgtcgacggttcgtttttccataaggacacctcactttaaagccagtataacatgattgtattgcaaaatgcaacattttttaaaattattgcgaaaagcattgattttattagaaaagtatgatacgcttatattgcaaaacgcagcaaagcttataatattgtgttgattcaaattatttttttaatttttagttgcgtttcgcaataaggaggggtgaaatgtaccagaaaaagcacaggacagcctccgacatacagggacgaggcggaaaaacaaatcaggaaaaaaaggcatacttgggacaataccgtgcgaatgagtgggagatacggcgcttacaggatgaattggctgatatacgcgcgcaggaacagcggctggaccgcctgttcggcggcgcatcctatgcagggatgcgctctctggacgaacttgatatgcgtatccgcgaatgtctgcatgagcatgtggcgctgcgcgacgagatagaagcgacgatccggacggttcccgaggaacggctgcgcacgctgctccgttttcgccacatcaacggctggacgcttgaacgcattgccggcgagatgaattacagctatatgcagatttgccgcctgcacggaaaggcgttgtccgaaatgatgctgtgaagcaggatgcagcgagcgtaaaatagtgaaattgcaaaatatccgcacggaaaggaggtgttttttctgaagggcatggatcagttcgatataacccaattgtgacactgtaaggctccatgcgaacgattttgcaggcgtggggccgtgcaatccgagggagggaaatgtatgaaaatcaattggaaggtacgtattaaaaatccgctatggtgggtacaggcggcgggggcgctggtgctgccggtactcgcatatttcggcctggcttgggaggatatgacctcctggggcgcgctgtgggatgtgttcctgcgcgcggtgcagaatcccgttgtgctgcttgctgctgcggtcagcgtgtttaacgctgtgaccgacccgacgacggccggcgtcggggacagccggcgggcgctcggatataagactccgaatcgtgacaaatgaagtcggtcaatgcggattgcggcttctaaaaaaggcagcgcatggtaaaataaccgctctgcggttattttaccggtttatggccagggcgatacgcgtgcgcggcccgctgccgctctgatgcccaattttaccatgccgcttcgcagacatggtaaaatgataatgctggcgctgttgcaaacggcaggcggttaagccttgccctgaaagggggcgttgcatatggactatggttggatcatccttgtgctgattttagtcacaggttacataattgcaataaaaaagattagccgccttcactccaatgacgcggctaatctttagctaaactcttgggggctaaccgtcagtcgacagcgccgcattatttttattatatccgtccaggaaacgcctgtcaagttgttgctggccttttgatcaatggtttaatcaacagaagccgcagggattttgattaaaggggcgtcagaagttgagcgggcggcatacctgtcacttggccgatacggtccaggatttccaggtttgtatggacctctgcgcgttcgatttcagcgtagcttttcacgctgagatcgatttgaaacgccatctcctcctggctgatccgcttctccgcgcgaaattccaaaaggttacacgctaaaatgactctggattcatcgtacttcataattacttcctcctgtctgctgtgcaacagtttatggaaataattgtatgaatcagccgcattttatcacaagggtgtcaacactcttgacaaattaattatagtataaaaattaactaaattatactttaaaattgtacttatatgtatttttttatgacacttccggggcttgtttaaaaatagaaaattgccggaatgttcgcaaacagcaagcgaatgcaaagcggaaaacgcaagaagcctttagatttcgaagcttttaacacagcatttaccactgtttgcagaaaaatacgagtagtttgatttttcaaacagcctctaatgtggggggattgagaaatgggagaagtcatcaaaggtattgatatttcatcgcatcagggagaaattgattttgagcgcgtgaaggcggacggcgtgcgctttgtgatcatcaaagccggacagggccttcgtgagatggggacgtttcgtcaaaaatacctgcccgctgtgctggccgcggggcttgactggggcgcgtactggtggagcgacgccgtgacggccgccgaagcgcaaaaggaggcggcggcattcgtcaaggcgctcgacggcctgcgcccgacctatccggtgtatatggaccaggaatacgaatctccctgcggtaacgcctggggagtgggcaagggaaagcagcttcgcaccgacatggcaaaggcgttcctgaaggttctggaggatgccgggtactacgcggggctgtacgcctcgacaaactggctgcaatactgggtggacgacagacagctcatggcttatgacaagtgggttgcacagtacgccgaaaaatgcacctatactggcagctatgggatgtggcagcatcatggagacgcgcggggctttgtagggcatgtggacggcatttccgtaccggtcgatatcaacgcctgctatcgggattatccggagatcatcaaggcaaacctgctcaatggctggacgcgcggggataagccggatactccgggaaacgggatgatcccaattcgcgcgtctgagctgacaagcttgcgtgacagcctgacagcggcgcttgattcggtgaaacggatgctgggggagctggggcatggagctgcttgaacggtttgttccgttacttgtcgcagtgctgacggcggtgactccaatagtgctggcgattcattcaagcggccgaaaagaccgcgcgcagggaaaggaaaattcagaaaagctgtgcggcgcggtcgaatcgctcaaggacagtattgaccggatggatacgcgcattgaaatcctggaaacacatgcgcaggaggaccacaggcggctgctcgtcatggaaatcctggaggaaaagctgccgattgaggagcggctgcgtgccggagaaaaatatgtggccgctgggtggaacggatcgatcaaggcaaagtaccagatgttgttggaggagtaccggcgcaagcagaaggaataacacacaataaaagaggggggcgcccagcgggcgtccccctcttttattggaacgttcggctatactccggcgtttttcattgcaaagcctgtggctttgtgatatcatcataaccgcggcaaacggttgaaaaagcctgtagatttggaggaatcacggtgaaagaaggcgcgattgaaatccggggcctcgacttttttagaagcggaaatgtgttcacaggcagcgttggcgaattccggttccggatttcgcccgaggatggcgcgctgaaagcatacgcttaccggacctactgctttgaaaaggcgcaggatgtgcgctccgaagcattttctctcgatgagtatggattggagcagttgaccaaatggttggagcagcagtgcgatgctttgattaagtaaagctgtaaatatgtggctatgacacaaaaatcagtgccatcaggagggttttagttgtgctttgtatgcagcctatgggcgctttggacaaaggatgctttaaaagttttctgataagaataggaaaataatagaaaaagggactgcgatttgcgctgttttgtgttacaattatcacaggaaaagattcggacagcccggagtggcggcggagcaagagcggacgctcccgacgttttacagcgtgggtttgaaagtgaaaaatctgccatcagccgcgcgaccggcggacacgcctttgaaacgcgggcctgaaggcccggcataaagaatgattcggggtggatgtcacaatgagcagacagacctgcaacatatgcccgcaccactgcacgcttgaggagggggagagcgggtactgctgtgcgcggagcaaccacgatggcgagatccgcaacgataattacggcatggtcacgctgctttctctggaccagatcgaaaaaaaatccctgcgccggttttatccgggcagccgggttctttccgtgggcagttacggctgtaatctgcgctgcccattttgccagaattatgccatttccatggccgatgggatgcacgcaggcgcgcagtatatcccgccggaggatctggtgcggcgcgccggggagtatgaaccggcaggcaatattggacttgcattcacatacaatgagccggtggtcggttatgaatatgtgcgcgattgtgcgcggcttgcagcaaggcgggggtttcatacagttcttgccacaaacggttacatctgtgaacagccgttgggcgagctgctgccgtatatcaatgcgatgtgcatcgatttgaagggcttttcagaggcgtcgtacagccgccttggcggcgatctgaaaactgtgtgttccaccattgagacggcggcgcgctgctgccatgtggaggtgacggtactggtgatccccggggaaaacgacactcccggccagatgcgccgcctatcgtcatggctggcggggatcagcccggagattgcgctgcatatcaaccgcttttttccgcattttcacatggcggaccgcgaggccacgccggtcgatgttgtgttttcactcgcggatgtggcgcgccgggcgcttccatatgtctatgtgggaagctgttagagcaaataaacaggattgtaaataaaaatctgtattcacagccggaggatgctggacaggcaaaagacctgcccaaactgcgcttgccgactgtgaatatgggttttaagatacgggaggcattaaaatgctggaagaaatcaaagagcaagcccgcgccgcagtattggaattgctggagtcagcgcgtctttcacgcggtgatatccttgttgtcggctgttcgtcgagcgaggtaatgggcgggcgtatcggcgccgcatcgagcacgcaagcggcggaggctgtgttcgcggggatttatcctgtgctttgccaaaatgggatttatcttgcggcgcagtgctgcgagcacctcaaccgggcgttggttgtggagcgggcgcttgtgcgggcctatggccttgacgaagtaaacgccgtgccgcagcccaaggctggcggctcgtttgccacagaggcgtatcaggcgtttgccgcgccggctgttgtggaacatctacgcgcgcacgccggtattgatatcggggataccttgattgggatgcatctgcgcgaggttgcggttccattgcggttgtctgtacgcacgatcgggcaggcgcatgtcgtctgcgcacgcacgaggcccaaatatatcggcggcgtccgcgcgcattataacgacgcgctgctttgaatggcgcacaggaggggcggccgccgaagatgcgggccgcttttggtcctttttttcccatttaagcttgacaaatgttgttccctgtgatatcatcaactacacaacaagatgactctcaggggagtagtcggcgtgacaggcgcagttgaatcaacatcacgggctgtttggccatggttcagcttgaaatgacaagacctgtgtttttccaaagcggagaaacgcgggtcttttcgtttgcacatttggggtatactgaatgacaaaaggaaggtgcagtttatggaatttctgttgtccggcattttggcggtcacatggcggcaggcggtgatgtatgtaatcggcggcgtgctgatctggctcgcggtgaaaaagggatttgagccggccctgctgctgccgatggggtttggttccattctggtcaatctgccgttttccggggcgctcgatcagatgcttcaaggcgggattgaatcgcacggcatcatccagtggctgtttgaaacgacgatccaggcgtccgaggcgatgccgattctgttatttatcggcatcggcgccatgatcgatttcgggccgctactgtcaaatccgcgcatgatgatcttcggcgcggccgcccagttcggcgtctttttcgcgttgagcgctacagtgctgctcgcgccgctgttcggacttgatatgacgctcatggacgccgcgtctatcggtgtgatcggcgcggccgacggcccgacggcgattctggtttcacagattttcaattctccctacatgggagcgattgcggtggcagcgtattcctatatggcgttggtgccgattgtgcagccggctgcaatccgtttggtcactaccaaaaaggagcgcatgatccggatgccttataatccgaaaacggtcagccggcgcacgcggattctgtttccgatcatcgtcacaatgatcgccggatttgtcgcgcccacctctgtggcgctcgtcggttttttgatgttcggaaacctgctgcgcgaatgcggcgtgcttgactcgctcgcccagactgcgcgcaatgagtttgcaaatattattacgcttttgctggggcttacgatttccttctccatgcgcgccgaggattttgtgcgcggtgaaacgctgtttatcctgtgcatcggtttaattgcatttgtgatggacacaatcggcggcgtgcttgtcgccaaactgttaaacgtgttttccaagaacaagatcaatccgatgatcggcgcggccggcatctcggcgtttcctatgtcggcccgcgtggtccagagcatggcgacaaaggaggaccgccaaaatcatcttttgatgcacgcaatcggcgccaatgtttccgggcagattggatcggtcatagcgggcggcatcattctgtacctggtgccgcggtttatttgataagggagggaatacaaatatgtttgatgctgcggcagcggcaaatttgattgcgtcgctgaaaattatggggcttggcatgggtgggatcttcgccgtcatgctgattattatgggtgtcgttgccctgctgggacgattcggggcggatgaggaggagccgtccggcaaatcgcagggatgaaaaaaggggcgtcccgcaggacgccctttttttatggcttcgtcagaactttttgcgcagcatggtgaagtcgaagaaatcggtatagaattcaagcgagcgcagcacagggcggctcaagcggcagaagcccacctcgtcgagcataagaagcgcgccgccgtccgggacctgcagcaaccgccggatggcgggcgtggcgtttgttgcgcagacatgcgcgatatcggtgatgacagtcagcccgcagcagcggtcgaggatatcaaagatcggcttggaccagtcgatggccatataatccatgccgtcaaagagcgacagcgcaaggtagtcgatggaatagatgacaggcgtatcgccggccagcacgcgtttttcacagacgatgacgcccgcgcccgcatcgagacgcaatgtttgggccagctcctcgtcggcctgctccacacgcagggacagactgtcactgcgtggactgcggccggcggcgagaatcagttcgttgtactcaaatttcaaatcaagacggcttttgaggttgacaatttcgcggttgatcaccgtgccgatgccgcgcacgcggtcgatcagcccctcgcgttcgagatcggagagcgcgtcgcggatgacggtgcggctgacgcttaggcgctcggccagttccacctccgacggcagacgctccgactgggcgaatacgccgccggtcagctccttgatcagcagggcgctgacctgggtggacatcagcttgccgcccagatgcggcaattcatattccggcatcatcgtattttcagcttctttcatcagggaatagccgcatgcggctgtaagaaattaacaatgcttctgcatatcttttatggaaaatggttcttgttttgtcatggcatttctgataaaatgaatgcggtaataagtatgactaattaattatttgcgaggattttccaataaatggagcgcatgtgcggttgcattgtgcaatggtatgtcttattatactcaaatttttataaaaagacaagcgccgaccgaagaaccaacaggaggaaccggatgaatcacgaaaaaaccttcgccctcaagggtgatattgtttatacagccgctcccggcggatttactgttgtggagcagggctatgccgtctgtgaaaacggccgttcggccggcgtgtttggcaggctgccggagcaatttgacggtatccatgtggaggactgcggacaaaaactgattataccgggattggttgacctgcacctgcatgcgccgcaatattcctttcgtggtcttggcatggatctcgaactgctcgactggctggagacgcacacctttccggaggaggcgaggttttgtgaccttgattacgcaaaacgcgcttacacgctgttcgccgacgcgctgtcgcgcggcgcgacgacgcgtgcctgtgtgttcgcgacggttcatgtgcctgctacgctgtgcctgatggagctgttggagcggacgggtatccgcgcgatggtcggcaaggtcaacatggaccgcaactgtcccgacagcctgcgcgagcaaagcgcggccgtttcgctcggcgagacgcggcgctggctggaaggctgcgccggcaaattcaaaaatgtgtcgcccattctgacgccgcgttttatcccttcgtgcaccgacgagctgatgcgcggattgggcgcgcttcaacaggcgacggggctgccggtgcagtcgcacctgtcggaaaatcattcggaaattgagtgggtgcggcagctctgcccggagtcggctttttacggcgacgcatacgaccggttcgggctgttcggcggcggctgtccgacgattatggcgcattgcgtgcacagctcggccgcggaaatcgatttgatgaagcggcgcggcgtattcatcgcgcactgtgcggcgtcgaacatgaacatctgttcaggcgtcgctccggtgcgcacatatcttgcgcgcgggatgaacgtggggcttggcaccgatgtggccggcggtttctctgattccgtgttccgtgcgatgagcgacgcaatccaggcttcaaagctgcgctggcgcctgacggacgattcgctcgctccgctgaccgtatcggaggcgttttatctcggcacaaagggcggcggcgcgttcttcggcaaggtcggctcgtttgaggcgggatatgaattcgacgcgcttgtcattgacgacgccgggctgccgcatccgcagcccctgacgcctgcagagcggctcgaacgcgtcgtctacctctccgacgaccgccatatcagcggcaagtatgttgcgggcgcgcgcgtgcggtaattaaaccggtatatgcaaagcgcgccatgcggcgcgcttcacataaaagggtgtcagcgaagcgccgccgctgtccaaggcgcggctttgccaacgcccggtcagggcagacacgcagaaaagcggcttttcgtgcgccaacggctgccggcggaaaacaggcggccgttgacgcgcggacaacgaaaggaggaggaatccggcatggcacagacaaacggtcaggggacactggagcgtttcttcaagctgaaggaacacaacacaaccgtccgcacagaggtggtggcgggcattacgacgtttgtggcgatggcgtatatcctagtggtcaacccgcagatgctcgcggacccgttttacatcatggagcagccggaatatgcggcgcaggtggcaaacggcgtcttttttgccacatgtctgatcgcgttttttggcacgtttttgatgtcggtctatgcgaaaatcccgtttgcacaggcgcccggcatggggctgaacgcattttttgcgtatacggttgtgctcggtatgggatacacttatgggcaggcgcttgcgatcgtttttatctccggaattctgtttatcgtgattacagcgatcggcttccgcgaggcgtgtgtgcgcgcgatcccgccgtgtgtgcgcggcgcgatcagcgccggaatcggcctgttccttgcgctgatcgggctgaaaaacgcggggctggtcgtttcaaacagctcgacgcttgtggcgctgatcgacttttccaaatggggcgacccggaactgcacgggctggtggcgtcggcgctggtggcgcttgtcgggctggttgtgatcggcgcgctgcacgcgcgcaggatcaaaggctcgattatcatcggcatcctggtggcgacaatcgtcggcgtcccgctcggcgtgacctcgttcggcggattttccatgaacatcggacagcagttctccgattttgtggatgtgtcgctgttcaaaatggatttcgcgggcctgttcgctgattccgccaatgtattccaaatggtgttcacactggtgatgatcgtcatatcgttttcgcttgtcgatatgtttgatacaatcggcacgctgctcggtacggccaaacaggcgaatatgctcgatcaaaacggcgatatgccgcgtatgcgtcaggcgatgatggccgacgcgctcgcgacgaccgtcggcgcgtgcctcggttcgtccacagcgacgacgtttgtcgaatcgagcaccggtatcgctgagggcggccgcacggggctgacctctctggtcacgtcgctgctgtttctcgcgtcgatcattatcgcgccgatcgtgggcatcgtgccgggcgcggcgaccgcgccggcgctgatttttgtgggcgttttgatgatgggttcaatcaaagagcttgactttacggatatgtccgaggccattccgtcgtttgtgaccgttacgttcatgccattcacctattcaattgctaacggcattgcgttcggtctgatcacctatgtgctgatcaagctgctctccggcaaggcgcgtgaaatcaggccgtttacggttgtgctgtgcctgctgtttgtgctgcgttttgcgtttatgaccaccggctgatcctgtccgcccgcgcccgtgtaaatacgggcgcgggtgttgtgctttttttggaaaagtgcttgcgcatccggtgcgggcatggtatacttgtaaaaatttaaaagtatgacttatgactaacggagcatacaaaacgaatcaagtggataagggggcttgtcaaatgggagtcggcagcagggccatccgcgtggatgcatgcgagaaggtgaccggcggggccaaatatacggatgatttgcgaccggcaaactgcctggttgcaaaggtggtgcgcagcaccgtggccaacgggcgcgtcaaggcgtttgatctggcgtccgcgctggcggtaccgggcgttgtaaagatcgtcacctgcttcgacgcgccgccgtttgaattcccgacggcggggcatccatggtcgaccgaaacggcgcatcaggatgtcgccgaccggcggctgctcaacgagcgcgtgcgtatctggggcgacgatatcgctgctgtcatcgctgaaaacgaggtggccgccgtgcgcgccgcgcggctggtgcgtgtggagtatgaggaataccccgtcgtgctcacgccgcaggaggcgatggcgcccggcgcgccggtcctgcacgacgcgcgcccggacaatgtgctggcgcacacaagctttaaaattggcgagggcagctatgaggaagcggcggccgcgcccgggctgcgcgtcgtcgaggggacgtatgagacgcagactgtccagcattgccacatcgaggagcctgtctgctatgcatacatggagaaagggcgcgtcgttgtagtttcgtcgacgcagatcccgcatattgtgcggcgcgtatgcagccaggcgacgggccttccgtttggtaaaatccgcgtcgtcaagccgtatattggcggcggcttcggcaacaagcaggaggttctgtatgaaccgctggcggcgtttttaacgatgcaggccggcggccgtccggtggaaatcgagctgtcgcgcgaggagacgtttgcatttacccgcgtgcgccatgcaatcgatttttcgctcaagacagccgtgcggcccgacggacggcttgtcgcgcgccgttatgaagcgtattccaatcagggcggctacgcctcgcacggccattcgatcgctgcgaacgcttcaaatgcgtaccggcatctctatcaggacgaacaggtgctcgacgccgatacatacaccgtttatacgaatatcgcgtccggcggcgcgatgcgcggctacggcatcccgcaggtcaattttgcgatggaggcgcacatggacgatgtggcgcgcgcaatcggcatggacccgatcgacctgcgtgtgaaaaactgtatgcgccagggctatgtcgatccgggtacgggcatcacctgctatacaagcggcctgcttggctgtctcgatcaagggaaaaaatacatcggatgggatgagaagcgcaaggcatacgccaatcagacgggcaatgtgcgccgcggcgtcggcatggcaatgttcagctacaagacgggcgtttatccgatttcactggagacggcgagcgcgcgcctggtgctcaaccaggatggtacggcgcagctccagatgggggcgaccgaaatcgggcagggcgcggacacggtgttcacacagatggcggcggagacgatcggttttcgcgacgaggatatccatatcgtatcgacgcaggacacagacgtgacgccgttcgacaccggcgcgtatgcgtcgcgccagacgtatgtcagcggcatggctctgaaaaagacggcgaaggtattccgcacgcggattctcgactatgccgaatatatgctcaagcgcggcgccgacaccatggatatccgcgagagctggatcgttgacgccgaaagcggcgaacgtctgctttccatgtccgatctcgcaatcgaatcgttttacagcctgaccaattcggtgcatatcaccgctgaggagacgaatcactgcaagagcaacacgttttcgtttggcgcgtgctttgcagagatcgaggtcgatatcccgcttggcaaaatcgaggtgctcgatatcatcaatgtgcatgacagtggaatgctgatcaacccggccctggccgaggcgcaggtccacggcggcatgagcatgggccttggctacgcgcttggcgaacagctccgctacgatgcgaaggggcggccgctcaacaacaacctgctcgactacaagctgcccacctcaatggacacgccggagctgcacgccgcgttcgtcgagacggacgacccgagcgcgccgtatggcaacaaatcgctcggcgagccgccggcaatcccggtggctccggcgatccgcaacgcgctgctgcacgcgacaggcgtcgcggtcaacagcctgccgctcaatccgcagaagctggtcgaggcgttcgcggccgcgggcatgattgcatcctgggagggctgagagatgtacgatattgaaaagatttatcaggccaaggacgttcccgacgcgatcgcggcgcttgcggccgccccggacgcggttgtgatctgcggcggcagcgacgtgcttgtcaaaatccgcgagggcaagctggccggatgttcgcttgtgagcatccacggactaaaggagcttgcgggcgtgcgcatggaggacgacgggaccatcgtcatcggcccggccacgacattcgcgcatgtgacgcgcgatccgatcatcgagcgccaccttcccgcgctcggcgcggcggtcgaccaggcgggcgggccgcagttgcgcaacgtcggcaccatcggcggcaacgtctgcaacggtgtgacgagcgccgacagcgcctccacgctgctgactctcaacgcgcttttggagctgactggcccggacggcaggcgcacggtcccgctctgcgatttttaccgcggcccgggaaaggtcgatctggcgcacggcgagctgttgacggccatccgcgtcgcaaaggccgactacgaggggttcggcggccattacatcaaatatgcgcagcgcaacgcgatggatatcgcgacgctcggctgcgcggtccatgtgaagctcgacgcagagaagcgcgccgttgaggagttgcggctcgcattcggcgtcgccgcgccgacgccggtgcgctgccgcgcggccgagcaggcggcgcgcggcaaagccgtttcgccggagctgttcgacgcggtgagcgaagccgccgcgggcgaggtcaacccgcgcacgagctggcgcgcgtcgcgcgcgtttcggatgcagcttgtgcgggaattgagccggcgcgcgctcaaacaggcgattatacatgcgggaggtgctgtgacatgctgaagctgatcaaaatgaccgtcaacggaaaggaagttgaaacggctgtcgatccgcgcgaaagcctgctcgatacgctgcgcaaccgtttggggcttacgagcgtcaagcgcggctgcgaggttggagaatgcggcgcgtgcacggtgcttgtcgacggcgaggcgatcgatagctgcatctatctggccgtctgggccgagggcaggacaattctgaccgtcgaggggctgcgcggcccaaacggcgagctgtcgccgatccagcaggcgtttatcgaggaggcggccgtacagtgcggcttctgtacgccggggctgatcatgacggccgtggagattgtcggcagcggaaaacggtacacgcgcgaggagctgcgcaagcagatttccgggcatctctgccgctgcacgggatatcagaacatcttaaacgcgatggaacgcatcgtcaacgagacatacaaggccgtcggtcaggactgatccgccggacagacagaagcaggccccgtgccggcgctgatagcgccggcacggggcctgctgttttttcggatcacgtcgcttcgcgtgggttgataaagacccccgacttgccgccgcttttttcggcgagatggatttcgccgatctccatggcgcggtcgatggccttgcacatgtcgtaaatggtgagcagcgccgttgaaacgccggtgagcgcctccatctccacgccggttttgccgctgacctgcgccgtgcagattgcttcgacggccggcaggtcgggatggagcttgaaatcgacagtacatttcgtcagcatcagcggatggcacagcgggatcagctcgctggtgcgcttggccgccatgatgcccgccacgcgcgcgacgccgagcacgtcgccctttttggccgtgccgccggcgatggcgtcaaaggtcgcccgctgcatccggattataccctttgccacagcgacgcggtcggtgatttccttgccgcccacgtcgaccatcacggcgttgccctgcgcgtcgatgtgtgtaagccccgccatcagacgccgccccttccaaagccgcagttcggaaagtggcacggctcgcagccgagacaaagcccgccgtttccaagccgcgcgagatcgcgttttgtcaccgggctgtcggccatgacgcgcgggagcaccaggtcgaaaattgtgcgcttggcatacatgacgcagcctggcaggcccatgacgggctttccgtcaagataggcgagcaggaacatcgcgccgggcaggaccggcgcgccgtagctgacgatcttggcgcccgtcgcgcggatggcagcgggggtgcggtcgtctgggtcgacgctcatgccgcccgtgcagacgacaagatcggctccgtccgcaaaaaacgcgcggatagcggcggtgataccctctggctcgtcgccgcacagcgtgacgcccatgatctcgccgccgaaggcttcaagcttctgcgcgacgaccggtgaaaaggtgtccttgatgcggccgaaaaagacttcgttgcccgtggtgacgatgccgcagcgttttttatggtacggcaggacccgcatgagcggacgctcccctgcgatgcgccgcgcctcgttcattttttcctcggaaatgacaagcgggatcacgcgcatccccgcaagcttgtcgcccttctgtacgggcgtgtggttgccccgcgcggcaatcatgatttcatccagggcgttgatttcgtcaaggcgttcgacgtcgatttcaaacaggccgtcgcaatcggcggacagctcgattttgccctccttgacggacgattcgttcatgtgatcatttttgcacaggccgcacaggatgcgcgcgccgtcgttttcgtggagcatccctgcctgcttctcccagatatagatgtaatccttgcccatggagagcagcaccgggatatcctcctcggtgacaatatggcccttgcgaaaccgcgcgtcctttgtgacgcctttgatgatctgtgtcatatcatggcagagcacctgtccgactgcgtcctgcgtcctgatctttttcatccgccgtccctctttcaaagcgtagtgtttttaaaaatagttcgcaagatcattctaccatgatccgaaaaaatgtcaatcgcgcgccttgccgaaagcgcatcggcgcggtaaaatagaggtgtgggaacgtcggcgtgcgggcagcgggggaggggctggttgaaaaatcaaaattaccgtctttttctgcaaacagcggcgaatgctgttaaaaaagcctctcaatccgaaaggattcctgcgttttttgccttgacttcttctgccgcctgcaaaaaatccggcgattcctatatttatacaagcctcaggcgaaggcggaagcatattcatgtgggatgtcaattgtgaaaaacaaccaaattctggactgatatttttttatcgaacttttcaaatccggttgtaactttctcgcgcttgcggtatcataagggtaagggccaataaaaaatataaggccaaaaaaatttttgtgaggaagttgcggctatgagtgaaatcagtaaaggtgcaagaggctccgtattcgaattgacgggcgtgccgccggccgggcaggtgcttccgctcgggctccagcatgtcgtcgcggcgattgtcggcgtcgtgacgccggcgatccttgtgtccaacacggtcggtcttgacagcgccgacaaaaccatcctgattcaggtttcccttttgatcacggcgatcgccaccctgatacaggtgtttggaaacgggcgtgtcggcgcggggctgccagtcatcatgggcatcagcttcgcctacgtgccgacgctgctggccatcggcggacagttcgatctgccgactatcctcggcgctgagatcgtgggcggctgcgtcgcgattgtattcggcatatttgtcaaatatctgcgcgtgttcttcccgccgcttgtaaccggaacggtcatctttacaatcggcctttcgctttacccgacggccgtcaagtatatggccggcggcgccggcagcgagggcttcggctcgtggcagaactggacggttgcgctgattacgctggcggtcgtcatcttctgcaaccactttacaaaaggcgttttcaagctggcgtccatcctgatcggtatggtggtcggctatattgtggcgctggcgatgggtatggtttccttttcggccgtcgcccagtccggttggtttgctgtcacagctccgctgcatttcggcatcaccttcaatgcgagcgcctgcatttcgctggcggtcatgtacattgtcaattccgtccagacaatcggcgatctgacttcgacgacgatcggcgggcttgaccgcgagccgacggaccgcgagctttccggcggcatcgttgcccagggcgtcatgagcgttgccggtgcattttttggcggcctgccggctgcaacgttcagccagaacgtgggaattgtgacagtcaaccgcgtcgtcaaccggattgtgttcgcatttgcggcgtgcgtgctgctcgtagcaggctttgtgccgaagttcgcgtcgctgctgacaacgattccgcagtgcgtcatcggcggtgcgaccatctcggtgttcgccaccatcacgatgacaggcatccgtatgatcacctctgcaaagctgacacagcgcaatgttgcgattgtcggcctgtcggtggcgctcggcgtcggcgtgaccacggtagaaggctgtctgtccgggttcccgagctgggttgcgacggtgttcggcagctcctcagttgtcatcgcgacgctgatggcgattttcctcaacctcattctgcccaaagaatccggacagaatcaataaatttggagcctgtattaagatcccatccgcttgaggtttttggccggcggtttccgggagcgcccttgcaggctcccggaagggatggctgcttttgcatgaattggtcgcggcgtatctgccgctggtggattttctggccgattgcctgggagagaatacggaagtcgtgttgcatgacctgtccgattggcaccgttcagttgtggccatccgcaacgggcatatcagcgggcgcgaaatcggctcgcccgtcacggatctggcgctgaaaattttaaagacaacggcgtttgacgagcggccgcatctggccaattaccacggcgtcgcgaaaaacggcaacccgcttcgttcatcgacccttttcattcgggacaagggcggcgagccggttggaatgctctgcatcaacagcgattgtcacagcctgctgcaggcccgcgacgcgctcgccgcattcatcgcggggatcggcctgcatgcggacgcgtccatcacggagagcttccatatgagcgtggaggagctggtgcgttcaaatctgcggcgcgtctgcccgcagatcgagctgcggatcgacacgctcagccagaaggaaaagctggagattgtagaagggctggatgagctggggaccttcctggtcaagggcgcgattgtttacgcagccgagagcctgaacgtttcggtgcctacgctttaccgctacctcaataccatccgcaaataagatgccaggcggcccccgctgtgcgggaaccgcctggcggacagcaagttcagggattcgttaagcttcttttgtggcatcaatgtagctgtaaagcgtatacttggagatgccgaagtatttggacactttgtcgccgcttttggtgatcaaaaacgcgccggtatcgttgagaaagcggagggccttgattttatcctccttgcccataagcgcaaccggtttgccgacaaggcgcacgctctgctcgatcagactgtcgagcagctcattgacgttttgagtgatgcgttcaggctctttttcgccgggctgctcgatggagatcagcggcttgatggcgttttcgatcagcagaagattggtgatgtcgtaattgatggaaaaaatgccgatggcgtcgccgttttcatcacggatatagatggtgctcgatttaaggatgcgcccatcgcgcgttttggtcagataattgaggtgatccttcaggttgctgcggtcgccgtgcagggcctcgagcacaacgtgcgaaggcccgtcgccgagcttgcggttggtgacatggccgttttcgatcgctacgatcgagctgtcgacgttgttgtcggtcaggtcgtgaacaacgacctcgcagcagttgccgaactgctgcgagattccgcgcgcgagctgccgcaggaaggtaagcgttgtttgttccagcataggcactccttcaaagcatttacgcttgaaatagtattttaagatactgttatcataccaagcgtccggtaaaatttcaataaaaagttgaccaatcaaaaaaattttttgagaaaaaacaatagaaggcttgcattttacagccgtccatggtaaactaaaattattaaaaacaaattgattattctgtatagtttgtggaatagtcggtctgttttttataaaaagcatattgtatgttggctgcaacggagtgcttcgcgcacgggccggatggacgcacaatcgggctgcgtgcctgggtccgccggtatggcaaagagcggcgacgggcgtccattcagggaatgggcgcccgttttaatgtgggcggacacaatcaggggaggtaaaaaccatgctgcttattggaaacggaaggctgatcacccgcggagaacacaaccgcctgatcgaaaacggctgtgtcgcggccgacggcagcgttatcgccgccgtcggtacaaccgatgagctgcgccggcactggcccggcgcccagttcatcgacgcgcacggcgggatgatcctgccggggctgattaacgcccacaaccacatctacagcgccttttcgcgcggcatcgcgatcaacggctataacccgcacaacttccttgacatcctcgacggcatgtggtggacgatcgaccgcaacctgcttttggaggacacgcgctacagcgcgctggcaacgtatatcgactgtgtcaagtgcggcgtgacaacggtgttcgaccaccacgccagcttcggcgagatccccggcagcctgttcgcaatcgcggacgccgccagtgagatcggcgtgcgcacctgtctgtgctatgaggtgtccgaccgtgacggagaggaaaagatgcgccaggctgtccgcgaaaatgccgatttcatcgcccactgcaagaaggacacgaccggcatggtcaggggcatgatgggtatgcacgcgtcgttcacactctccgacgcgacgctcgccctctgccgtgagcatacgccgtccgatatcggcttccatatccatgtggcggaggggatggcagacgtctacgactcactgaaaaaatatggaaaacgcgtcatcaaccggctgtatgacaacgatatcctcggtgaaaagacgattaccggccactgtatccacatcaacggcatcgagatggatattttaaaggaaacgaacacgatggtcgtacataatccggaatcgaacatgggcaacgctgtcggctgcccgccgacaatggagatgatccgccgcggcctgctggtcgggcttgggacagacggctacacgaacgatatgtatgaatcgatgaaggctgcaaactgcctgcataagcacaacctctgcgacccgaccgccgcctggggagaggtgccgtatatgctgttcgagggcaatccggccatcggcgcgcgttacttcgacaagaagctcggcgtgcttgaggaaggcgccgccgccgacatcatcgtcaccgattacgacccgttgaccccgctgacggccgacaacatcaacggtcacacgctgtttggcatgagcggccggcagaccgtcacgaccgtaatcgacggcaaggtgcgtatgcaggaccgcgagctggtcgacatcgacgaaaagaaaatccttgcggaggcgcgcgcgcatgcgcaggcgatgtggaaccgtatcaactcaaggtaaaattgaccggttatattacgaattggatcgggctgcggccggtcacagacgcaaatgggctgacagaaggccccgcaaaattgggaggaatgatttatgggcgatcgcatgaggccaatcccgtttggcaagctgatggattggatcatcacagaataccagacgcaggggagtattttcggcgtggcgaagctgttccgccaccagtccggcgacaagatgctgccgctgttcggcgagcggatggaggctccgttcgggccggccgccggcccgcatacgcagttggcgcagaacatcgttgcggcctatgccgcgggcagccgtttctttgaattaaaaaccgtgcagcagctcgacggcgaggatctgccggtcgccaagccgtgcatcaacgcggaggatgaatgctacaatgtcgaatggtcgaccgagctgcgcgtaccggaggcatacgctgaatatgtcaaggcgtggtttgcgctcaagctgatttcccgcgcgttcggtctgggagacgaatgcggcttcatctttaacatgagcgtcgggtacgatctggaggggataaaatccccgaagatcgacgcgttcatcgaagggctgaaggacgcgtccgtgtcgccggtgtgggcagagtgtaaagcctgggcgcttgacaatcttgcgcgcctgccgcgcattgacgccgcgtttgtcgaagcggttacgccgcatatctgtacgtcgatcactctgtcgacgctgcacggctgcccgccgcaggagatcgagcgcatcgcaacgtacctgctgacggaaaagaggctaaacacctatatcaagtgcaatccgacgctgcttggatatgaatacgcgcgccagacgatggatgcgcttggatttgattacatcgcgtttgacgaccatcatttcaaggaggacctccagtttgccgacgccgtgccgatgatccggcgtctccaggcgttggccgacgggaaggggctgaccttcggcgttaagctgacaaataccttcccggtcgatatcgccgccggcgagctgcccggaaacgaaatgtacatgtcgggccggtcgctttatccgctgacgatctccgtcgccaagcttctttccaaggagtttgacggcaagctgcgcatctcctattccggcggggcggatgcctacaatattgaaaagctgtttgcggcggggatttggccgatcacactggccacgacgcttttaaaacccggcggctaccagcgtctttaccagctcgcggaaaagctttataactgcggcgatcagccgttttcgggcgtgcatgtggccaaggtgtgcgagtttgtcgaggacgcgatgactgacccgtattaccgcaagccggtcaagccactgcccggccgcaagatggaccggaaagtccctcttatcgactgtttcgaggcgccgtgccgttccggctgcccgattgagcaggatatcccggcgtatctgcgtctggcggggcagggaaactatctggaggcgctgcgcgtcatcaccgcgcgcaatccgctgccgtttatcaccggcaccatctgcccgcatcactgcgctgacaaatgtacgcgcaatttctatgaggattccatacatattcgcgccgtcaagctggagtgcgcgcagcatgcgttccaggaactgacggcaggcatggagaaggccgctcccacagcgggcgtaaaggccgcgattgtcggcggcgggccggcgggcatcgcggcggcgtattttctggcgcgcgccggcgtgtctgtcaccgtgttcgaaaagcgggagacgctcggcggcattgtgcgccatgtgatcccgtcgttccgaatccctggagatgcgattgaaaacgacgtcgcgctcgcaaaggctgccggcgcgcagtttgtgaccggcgccgaggtcacttctgtcgacgagctgaaggcgaagggctttacgcatgtgatcctcgcggtcggcgcctggaaaccgggcgtgctcaagcttgaatatggcgagccgatgggcgtgctggaatttttaacggcttacaatcgcgcctccgcatcgctttcgctcggtgaaaacgtcgtcgtcatcggcggcggcaacactgcgatggacgccgcgcgcgcggctgtgcgcgtaccgggcgtcaggagggtgcgccttgtttaccgccgcacaaagcgttacatgccggcggacgaggaggagcttgcgctggcgatcgaggacggcgtggagttctgcgagctgctcgcgccggtcggagtgcgcgacggcgtattgacgtgcggccgcatggagcttggcgcgcccgacgcgtccggccgccgcagtccggtcgcgacaggcgagacaatcgaactgccggccgatacggtcatcgcggccgtcggcgagcaggtcgatacggcgttttatgaaaggaacggcatcgccgtcgacgcgcgcggccgcgcgcaatgcgacgctaagacgctggagacgaatgtgaaaaacgtctatgtagcgggcgacgcctaccgcgggcctgccacggttgtcgaggcgattgcagacgcgatgaaggcggtcggcgcgatcgcggacatcgcggcggaccgctgcgcctgcaaaaacgtatccgacgactataaccatgcgcttaaaaagaagggcgctctctatccggagggcgagggctgcacagagccgggccgctgcctggaatgcgcgactgtctgcgaatgctgcgccgatgtctgcccgaatcgcgccaatatcgctgtgcatgtgcctggcaggcgtatgcgccagatcatccacatcgacggcatgtgcaacgagtgcggcaactgcgctacgttctgcccgtatgacagcgcgccctacaaggagaaattcacgctgttctggagcgaggccgactttaacgacagcaaaaatgaaggcttcctgctgctcgacgacgcgcggcagacgtaccgtgtccgcctcgacgggcaggtggccgactatacgctcggcgaatcggacggcggtctgaccgccgatttggccgcgctgatccgggctgcgcgccgcgactacgcgtacctgttttaacaaatcagggcggggcaaagccccgccctgaagcccgttttgaacttcctttcatgcggcggtccaaaattgacgcgcgaaaagccccatagccgctggcggggcttttcgctcctgtttaaagccagcttgcagcggcagaatggagtttgatatgaaaattctgattaaaaacgggcgcgtcgtaacaccgcgcgggacgtgtgcagccgatgtgctgattgagggcagccgcatcgcgcaggtgggggaaggactgtccgaaagcggctgtaatctctatgacgcggccggttgcctgctgttcccgggatttatcgacgcgcatacacatctcgacatggacaacggcgtgactgtatcgtcggacgactttgaaacagggacggcggcggctgtctgcggaggaacgacaaccatccttgatttcgcaacacaggaccgcggcgggacgctggccaaggcgcttgcggactggcatacgaagtccgatggaaaagcgtcgtgcgattatgggttccatatggcaatcaccgattggaacgacgaggtttcacgggagatcgacggcatggcgcaggccggcgtgacgtcgtttaagctctatctggcgtatgacaacctgcgcctgccggacgggcaggtttatgaggtattaaagcgcgtccatcagatcggcggcatcgttggaacacactgtgaaaacggcgatttgatcaatgagctggccggcgagctgcgccgtgcgggcaagctgtcgccgcgttaccacccgttcgcgcgtcctgactatgtcgaggcggaggcgatcgcgcgctattgctatatcgcgctggcggcggacgctccggtcaatatcgtccatctgagcacacgcctgggacttgaggaagcacggcgcgcgcgggcgcgcgggcagcaggtgtatattgaaacctgtccgcagtatctcatgcttgatgaatcgctttacgaacagccgggctttgaggcggcaaagtatgtctgttcgccgccgctgcgtacagccgccgaccgtgcggcgctgtgggatgccatctcaaacaatgaggtcgacacgatttccacggatcattgcgggtacaatttcaagggacaaaaagagcttggccgagacgacttcatgaaaattccaaatgggatgccgggtgtggagcaccggccggcggtgctctatacatacggcgtcgaagccggccgcatgacagagggccagatggccgccatgctttccgaaaacacggcgcgactgttcggcatgtatccgcaaaaaggcgtcgttgcgccgggcgcggacgccgatatcgttgtgtgggacccatcatacagcggcgtgatcagcgtgcggacacagcatcagaactgcgattacacgccgcttgaggggatggctgtgcatggccgagcgaaagctgttttcctgcgcggcgagcaggtcgtgtcggacggggaagtgatccgcgcgcatcgcggcgcgtttgtcgcgcgcgggaggtccgatctgcaacggtgacatcgcggcaagcatctaaaaaaataggtccgtgacagctttgctgtcacgggccttttctttcggaaagcgggggattgcaaaatccgcgccagccgcgcgacgtctgtcacgccttctgctgacggcaggccctgtgtctgaacaaggcgtcttgcggcctgcgggccgcgcttttttgtagggctgcggcccagggtttgagggcgctgccctcgaaaacggccaagacccgcaatgggccttggccattttctcacccgccgccttttgaaaaaggcgggcgaaaacttttgtttgcgatgcgccaagccttctgttcgcggcgcagccgactaaagttttttggcccacctttttttcaaaaaaggtgggaagttttttgccaagcttttttcaaaaaagcgggcgaagggaggcggcgtcggcgcggtaatcgatgtcgaccagctcgagacggtttttcgtctccacaatgcgcaaaagcggcatatgcgccgcgacgaccgcgccgcctgactggcctggcgcgagcgcgcccaactctgaaaacagcgcgcgcgggaacaggaccgggttgccgcgcttgccgcggtagccgagcgccacaatggcgccgggatgcgcaatgaattcatcgacaatcgcctggatactgcgcgcggtcaaaagcggctgatcgcagacggaaaaaaggcatccgtccagattcggcgtgagcgcgtcaaggccgagacggatcgtgcgggcgacgctatcgtccgcaccgtcgttttcaacaaccgtaaatccgcgctgcgccgccgtaacagcaacctcggcataacgcgttacgacaattgtctgattgaacagctcgcagggaaaattgccgagcaccgtttcaatcatcggccgcccgttgaattcagagagcagcttgttgccctgaaaccgcttcgattgcccggatgcgagaaaaatacatcccagtttgagagaagcgcccatatcgccacgacctccatcactgcggcccacgctgcgcgtaagccggtcatttcttctattatataggatgcgcgccgctttgcgcaaggcaaaacggcgcgccggagcttttatttttttcggctgtacggcgtctgttcgagcggcaggcgcgtgcggaatatgccgtcgcggttgtagtaggcgagctggacggcgggcggcgtcgggatcgaggcgatttctccgatccccttcgcgccgcaggccagctcggaatgcgccggaccttcgacaatgatcgattcgacgtcgggcgtgcggtcggccttaaagagtccgagcgtaccgaattttgcggtcggacggccgtctgcaagcgggaagtcctcagtcagcgcatagccgaggctcatcacgacgccaccctcaatctgtccctctacgctgattggattgacagcctgccccacgtcgtgcgccgcgatcaccttgcaaatgcggccgtcgtcgtcgagatcaacgagatgggtggcgtaaccataagcgatatggctgactgggttgggcttgtcggaccccattttgtcggtcgcgccgaggtattcgccaaggaattcacggccgtttaaagccgagagcggtccgccgccgcgcgcttgggcgagacgcagggccgcgcgccgcgtcgcttcgccggtaaaaagcgtctgacgcgacgccgtcgtgttgccggaatcgggcgcgccggccgtgtcgggcgtctcgtagacgacctcgtccgctgaaaggcccgccgcctcgcaggcaatctgtgtgacaatcgtgccaagcccttgcccgatacaggcggcgcttgtacggatatgcacccgcccgtcctcaacggtcaggcggcagcgcccggcgtccgggatgcccacgccaaggccgctgtttttcatcgcgcaggcgacgcccgccttgggatgcgcgtcgtaatacggcttgaccgcctcaagcgtttcgacaagcgccgtcgtctcatcggcgatctgcccgttgggcaaaacctggccggggcggattgcgttgcggtaacggatttcccagggggtaatgccgaccatttcggccagcaggttcaggttgcattcggtcgcaaagcagctctgcgtcacaccgaaaccccgaaacgccccgcacggcggattgttagtgtagtaagccttgccgtcgatctcgatatcctgatagttgtacggcccggccgcgtgcgtacatgcgcgctggagcaccggtccgccgagcgacgcgtacgcgccggtgtccgcaacgagcgtcgccttcatcgcggtgaggcggccgttttcatcgcaggccgtcgtaaactccatttcaaagccgtggcgctttggatggacaaggatgctttcggcgcgcgtgagggaaaccttgacaggccgctgtgtgagcacagcgagcacggcggcgtggtgctggacgctcatatcctccttgccgccgaaaccgccgccgaccatcttggcgacgacgcgcaccttttcaggcggcaggcccgtcgcctcggcgcattcgcgttttgtctgatagatcccctggtcggcgctgtagatcacgacgccgtcgccctcgggcatggcgaccgccgtctccggctccaaaaacgcgtgctcggtcggcggcgtgctgtagcggcgtgtgacgacgtatttggagcggcggattttttcctccgcgttgccgcgtacaaggtgctcatgcgcgagcaggttgccgctttcatgcacctgcggcgcgccgtccgccatcgcctcggcggccgaaaggacgggcgtcagctcctcgtattcgaccgcgacgagcttttttgcctcctcaagcgcctctttagtctcagccgcgacgagcgccacagcatctccgaggaaatgcgtgatcccgcctacagggatcagcacatcgtaatcctttttcagatggccgaccttctgcttgcctggcaggccggcggccgtgatgacggctgcgacgccggggagggcgcgcgccttcgacacgtcgattgaaaggacgcgcgcgcgcgggtacgcgctgcgcacggcgctgccgtaaagcatgccagggatgcgcatatcgtcggcatattccgcgtcgccgagcactttggcgggcgcgtcgacgcgcggcatgttttctccgacgcgcggcccgggcgccgtctgcgggacaggcaggccctcgcgcagatatttggcggcgagcaaaacggcctccaggatttttttatagccggtgcaccggcagatattgtttttgagcgcctggcgcacctggtcgggcgtggggtcgggcacggcgtcgatgaggcccttggcgctgatgaccataccgggcgtgcagaaaccgcactgcactgcgccgcagcttgtgaaggcccaggcgtaaacgtcgcgctcgcggggggaaagcccctcgcaggtgacgatcgatttgccggcgcacttcgaggttttgagcacgcatgccttggtcgccttgccgtcgacaaggaccatgcatgtgccgcaggccccttccgagcagccgtttttcaccgaggtaagcccgagcgtttcacgcaggaaaacgatcagtttttcgtcccgttgggcgcgaaccgccgcgccgtttaccatcatttcaaacattgcacaagtcctccatcctgacaggccagtgagcggaaagccgcgttaaaatagtacgacttttataattatggtataagtttatcatctatatgttgggaaatcaagtggttaattgccaaaatcaaaaaaatatttagataaataaaatttttttaagaaaaggcattgacttcctttctttctgtgctatgatgggattacaggaaaaagtcataccaggatcgattttcacaggaggatggcttgtatggagcagatcaaatgggccgccaaccgcatgccgaaaagcggcgaccggcagcttggcgtgatgtcgcttgagaatgtcgccaaggcccgcaaattccaccgcagtttcccacagtattccgtcacgccgctcgcacggctcgacaacatggctgcgcagctcgggctgggcgggctgttcgtcaaggatgaatcgtaccgctttggactcaacgccttcaaggtgctcggcggctcgttcgcaatggcgcgctacatcgcgcagcagctcggacgcgatgtctccgagatgacctatgaatacctgacctcgcaaaagctgcgcgacgaattcggccaggcgaccttcttcaccgccaccgacggcaaccacggccgcggcgtcgcctgggcggccaaccgcctggggcagaaggccgtcgtacatatgcccaagggcagcacgaagccccgctttgacaacatcgccgccgagggcgcgaaggtcacgattgaaaaggtcaactacgacgactgcgtgcgcatggccgccgccgaagcggccgagacgccgcgcggcgtcgttgtgcaggacaccgcctgggagggctatgaggagatcccggcgtggatcatgcagggctatgggaccatggcttcggaagccgccgagcagctcaaagaggccggcgtcgaccggccgacgcacatctttgtacaggcaggcgtcggttcgctggccggagcggtgcagggctactttgcaaacctgttcccggactgcacgccgacgaccgtcatcatggaggcgcaggccgcggactgtctttacaagggcgcggtagcgtgcgacggggatctgcgcattgtcgacggcgaccttcgaacgatcatggccgggctggcctgcggagagccgaacaccatttcgtgggatatcttaaaaaatcacagcagctttttcgtctcctgccctgactgggtggcagccaaggggatgcgcatgctcgctgcgccgtgcaggggcgaccggcaggtcgtctccggcgaaagcggcgccgtcggcatggggcttgtcgccacgctgatggaaaacgacgactacagggaattgcgcgaggcgatcgggctcgataagaacagccgtgtgctgatgttctcaaccgagggcgacaccgacccggaaaactacaggcgtatcgtttgggacggggcgcatccgtccgcgcgctgaacgattggatcatgcaccgaatataaacaggcagtctgcaaggaggaaacgacaatggatttttcgaagatcaaagcggcggccgagggttaccgcgccgacatgacaaaatttttgcgcgagcttgtcgccatcccgggcgagagctgcggcgaggagggccacatccgccgcatcgaagccgagatgaaaaaggtcggctttgacaaggtcgtcatcgacccgatgggcaacgtcatgggctacatgggcgccggcaagacgctgatcggctacgacgcgcacatcgacaccgtgggcgtcggcaaccgcgacaactggacgttcgacccctacgagggctttgagacggacgaggagatcggcggacgcggcacgtccgaccagctcggcggcatcgtctcggccgtatacggcgcgaagatcatgaaggatctgggcctgctctccgacaagtacacggtgctcgtcaccggtacggtgcaggaggaggactgcgacgggctttgctggcagtatatcatcaacgaggataaggtgaagccggaattcgtcgtcatcaccgagccgaccgacggcaacatctaccgcggccagcgcggcaggatggagatccgcgtcgacgtcaagggcgtttcatgtcacggatccgcgccggagcgcggcgataacgccatctataagatggccgacatcctccaggatatccgcgagctgaacaaccacctgcactttgacccgttcctcggcaagggcacggtgacgacctccgaaatcttctttacatcgccttcgcgctgcgcggtcgccgattcgtgcgccgtttcgctggaccgccgcctcaccgacggcgagacgtaccagtccgcgctggaggaggtgcgcaatctgccgtccgtcaagaagtacggcgccgaggtttcgatgtacaaatacgagcgtccgtcctggacagggctgagctatccgaccgacgcgtacttcccgacctgggttatcccggaggatcatccggcgaccaccgcgatggtcgaggcgtaccgcggcatgtacggcgagccgaaggtcgataagtggaccttctccaccaacggcgtttcgatcatggggcgctacgggattccgtgcatcggcttcggccccggcaaggaggcacaggcgcatgcccccaacgaaaaaacctggaaggaagacttggtgcgctgcgccgccgtctatgccgcgctgccgacaatgtattgtaaatagaacacaaatgtatcgatcacaaaatttgaagtttttggataatacgctttgttttgagatgtaaaaaccgacatgtttcataaattacatctaaatgtattgaaataacaggccgattcgtgtatgctgtatatataatgaatatagtgctcaaaatcggcctgcaacacatagacgattgattgtgaaggggtaacaataatggatcagaaattgcaggcttatatcgataaactcaacaagctcaacttcaagggcatgtacgaaaatgatttcttcctcacctgggagaaaacgaacgacgagttggaagccgtctttactgtcgccgacgcgctgcgctacatgcgcgagcagaacatctccaccaagatttttgagagcggccttggcatctcgctgttccgcgacaattcgacgcgcacgcgcttcagcttcgcctccgcctgcaacatgctcgggctggaggttcaggacctcgacgagggcaaatcgcaggtcgcgcacggcgagacggtccgcgagacggcgaacatgatctccttcatggccgatgttatcggtatccgcgatgatatgtacatcggcaagggcaacgcctatatgcatgaggtttcccagtcggtgcgcgagggttaccgcgacggcgtgctcgagcagatcccgacgcttgtcaaccttcagtgcgatatcgaccatccgacccagtgcatggccgatacgctgcacctgatccatgagttcggcggccttgagaacctcaagggcaaaaaggtcgcgatgacttgggcgtattctccatcgtacggcaagccgctgtccgtcccgcagggcgtcatcggtctgatgacccgtttcggcatggacgttgtgctggcgcatcccgaagggtatgaggtcatgcccgaggttgaggaggtcgccaaaaagaacgcggtcgcttccggcggcagcttccgccgcaccaattcgatggccgacgcgttcaaggacgccgatattgtctatcccaagagctgggcgccgttcgccgcgatggaaaagcgcacgaacctgtatggcgagggcgacgccgaaggcatcaaggcgcttgaaaaggagctgctcgcacagaatgccgagcataaggattggtgctgcaccgaggagcttatgaaaacgacaaaggacggcaaggcgctctatctgcactgcctgccggccgatatcaacgatgtctcctgcaaggacggcgaggttgaggcgtccgtgttcgaccgttaccgcacgccgctttacaaagaggcgagctacaagccgtatgtcatcgcagcaatgatgttcttagcgaaggtcagggacccgcagcaggtgctcaaggcgctcgaggagcgcaaaacggcgcgctggatcggttgattgccggtccctgcgccgcccctccgccagtcagataaacgccgctgtcgccagaggcgtgcaaaatatgaataaaggtggtacttatcatgggaaaaagaatcgttatcgccctcggcggaaacgctctcggcaacaatctcccggaacagatgattgccgtcaaacagacctccaaggcgattgcggatttgattcaggaggggcatgaggtcatcatttcccacgggaacggaccgcaggtcggcatgattcaaaaggcgatggccgcgctcacggcatccgattcaaaatacggcgcggttccgctgtccgtgtgcggcgcaatgagccagggatatattggttatgatctgcaaaacgcgctgcgcgaggagctgctcgaccgcggtatcagaaagcctgtttccacgattattacgcaggtgattgtcgacccgcgcgatcctgcgttcgagcatccgaccaaaccgatcggcaatttcctgtccgaggaggacgccaagcgcctcgtcaaagaaaagggatacacagttgtcgaggacgccggccgcggctggcggcgtgtggtcgcttcgccgaagccgcagcatatcgttgagattgaaacgatccgcgccctcatggacgctgggcaggttgttgtggccgccgggggcggcgggattcccgttatggagacggagggcaatcatctcaaaggcgccgccgcagtcatcgataaggacttttgcagcgcgtgcctggcggagcttgtcgatgcggactgcctgatcatcctgacagcggttgaaaaggtcgcgataaactttggaaagccgaatcaggaatggctgtccgagctgacgcctgaacgcgcccgcgtattgatcgccgaagggcatttcgcacccggttcgatgctgccaaaggtccaggcggccgtccagttctccgaatcaaaggccgaccgttatgcattgattacgctgcttgaaaaagcaaaagacggtattgagggaaagaccggaacgatcatccgttgatgcagtacacaacgtagtctttaaatccccgtccgcgaaaatgcacgggcggggatttttttacagcaggatgacaaaagccgccccgtatggggcggcttttgccgattgtggtaagtttatgggggtgctgattgtttatcagcttgatccatgcctatattatagcataggcaggtttaaaatagaaattataaatttctatatgtgaactgatttatagataaaatatattaattaacgattgtcaaggatcggtacgaacaagccgttttccgcccggacaagctgttcggaactgctgccgataaaagggattgggtcctcagcgcacgaaaagcgcgcgcatgttccacaggaggagctgagactgcgcggaacaggggaaagctgcgcgcggataccgtgcgcagccagagtccgcacgcttttgagtgcgtcgtaatgggtgaaaaacgttgcgatataatcggccaaatcctatccctccgcctgtattcagagcgtaagcgtcagacggtagtcgccgccttcggtcgctgccgttacatgataaccggcgtgttcagcaaaacgcgtgacattctctttcgcggttggattatccacgagcacctcgcaggatgccggggatccggccagcagatttttggtcataacgaccggctgcgggcaggaaagtccgcgcgcatcaatacagtcagccataaataaaacctcctcaattaagcggttatcttttgttttgtgtccgcggcaacggtttcgcgcgtattgagccacgcgattgcaaacatgacgataagcgccagaatggtgacagttttgcccgccagggtcggacctccggtaatcgcaccatcctccgcaacggctgtggcggcggaagcaaggccgaaattgtgggcgaatgccgcgccgacaaaaaatccggcaacagtcacagcggaatcggagtttccttcacctgccagaatcaactggcgcatcgggcagccgccgagcaggacagagccgagtcccacagcggacatggaaaggaaattccaaagtccatcgatatgcgcgacaggctggcccataaagccgaccttgaaatagccgccaaacaccgcgttcagaacggcattgctgacaagcgccgctgccaggatcgccgcgaagccggccagaagggtccagtccttaaagagaagaacgtcgcggatgccgccaaccatgcacagacgcgtgcgctgtgcaagcgcaccgacgatcagaccggccgcgagcgaaatccaaacaggcgcacgcatggagccgggaccgctttcgctgaacagtatgtaggcgggcgcggcacagagcagtgcgaaaaagacgacttggatcaccgacagccacgcgccgtcaattaccgggacggagtaggtgcgtttgaggctgtagccgcgccccagaaattggacgccggcaaagatgccaaccgcaaagccgacgattccgacgaccgcgttgagatcgccgccggcgatacgcaggatcatgcggaacggacatccgagaaagacaagcgccgtgatcatgacaaaaaatccaaggacaaaccgtgtcatcggcgaggagccgccgcgtggaaggaattcctttttgaccgccgcgatcacaaacgcgccaagaaccaatccaatgatttcaggccggatatattgcacggcggcggcctgatgcagtcccacagcgccggcggtatcacggataaaacaagcgatacaaaaccccatatttttgggatttccgagcagaacgagtacagcggcgatgattccaataatcagccccgctccaatcattttttgcttccctctcaaaacaaacaccactttcaacaaaaaagatcgtggaatcgcgaatcctttggtgttattatacttccagaggagagaaatgaaaaattgtttttttaaatacaagattgcttacatatagaaattttctatatatatagaattcgcggttgcagacatagtacaatagataaagaaagcatggacctgtgcggccccaaaatgaaaggcggtataatgatgcagcgcatctatcttgacaatgcggccacctcctatccaaagccaaaggaggtggcgcgcgccgtggcggactatattgacaacatcggctgcaatgtaaaccgcggcgggtatgcagcggcttattccgccgcccaggtcgttctggatacgcgagaacagctctgccggttgtttcatttcccggatccgcgcggcgttatttttacagccaatatcacagtttcgctcaatatgctgctcaagggcctgctgcgcccgggcgaccatgtgctcgtcagcgcgatggagcacaatgccgtcatgcgtccgcttgtgcagcttgcacagcaaggcgtatcgtttgaccgcattcctgccaaccgggacgggcagctgccggattcatcgctggaaagctgtctctcctcgctgctgcgcccacagacgcgcgcggtgatcatggcgcatgcctctaatgtttgcggtacgattctgccgatcgaacgcgtcggcgcgttttgccgcgcgcatgggctttttttcattgtggactgcgcgcagacaggcggcgtcgaatcaatcgatatggaagctatgcatatcgacgcgcttgcctttaccggccacaagggtttattgggcccgcagggaatcggcggttttttggcgcatgatgcgcttgccgcacagatggagccgcttctttcaggcgggacaggcagtttttccgacctcgaaaccgttccggagctgctgccggaccgcttcgaacccggaacgccgaacctgcccggaattttcggcctgcatgcagctttgcaatatctggaacagactggaatggatatgattcgcgagagggagcaggcgttgacacagcggtttatcaaacgtctgcatggtgataaacgtatccgtatcgtcgctgaaagtgcggcgcggcggatgtctgtcgtttccctcgattttatcggggctgataatgctgagattgcatttcgccttgattcagaatatggggtgatgacacgctgcggactgcactgcgcgccgaacgcgcataaggtgcttgggacattcccgcagggaacggtgcgcttttcttttggccattttaattctgaggaacaggtggattatacagcggatgctgttttaaacattttggcgtcggagggataggcgatggatgaacggcaaacgctgctgcgttccattccggctgcggacgtgctgctgcgcgcgccgtcgcttgaggcggcggcgcgcgcacacgggggcgcggcggtgctcggcgcggttcgcgccgagctggacgcgcttcgcgcgtccgtattgcacggcgaagcgcgcgcaattccgccgcgccccgacctgtgcgcagccgctttgcagcggctgcgcacaggccagacgatgcggctgcgtcatgtagtcaatgcgaccggcgttgcactgcatacaaatctgggccgtgcgccgctggcagacgcggcgtgtacggccgtgcaggaggcggcgtccaattatacaaatcttgaatatacgttggaaacaggcgcgcgcggcagccgtaccgctgcggtggaggagctgttgtgcgtcttatgcggttgtgaagcggcctttgttgtcaataacaatgccgccgcagtgctgcttgcgttggccgctctgtcgcgtggaaaaggcgcggcagtgtcgcgcggcgagcttgtagagatcggcgatgggttccgtctgcgcgatatcctggaggaaagcggagcgcgggtggtggaggtcggcgcaaccaaccgcacgcataccgacgattatgagcgggccgccagggaaaatgatcttgccgtcctattcaaagcgcatacaagcaatttccggatggttggttttacacagtccgtttcgcttcgtgaattggcacggatcggcgtgcgttatggcctggcgacagtggcggacctcggcggcggcgcgccgctggacgaggcggcgtatccgttttccggagaaccgtccatatcgagggcgctgcgcgacggcgcagatattgtctgcttcagcggcgacaaacttcttggcggaccgcaggccggcatcctgcttggacgcgcagaattgatcggacggatgcgtctgcatccactggcacgcgcgctgcgcatagacaagctgtcgctggcggcgcttgaggcgaccttgcgcctctattgcgacccggcgcgcgccggcaacgagataccggcgctaaggatgctttgtacagctcctgagacactgcgcgcgcgcgccgtctatttaaacaaattgattgaacaggaaggcgccaattgtgcaaccgagattatttctgtgaaacggccggtcggcggcggatgcgcgccttcagccctgcttgacgggttcgctgtcgcggttttgcctgcggcgctgcatgtggaaacgctggaggcgcgcctgcgcgcggccgcgccattgccggtcgtcgcgcggatctcgcagggacggctgcttttggatacggcgaccatccgcgacgacgaatgtccggctgtcgctgccgcggtgaaagctgggtgcgtgctatgaaaacggttctgattgtaacggccggccatgtcgaccatgggaaaacagccctgatccaatcgctgaccggcgtcaacacggatcgcctggaggaggagcagcggcgcggcatgacgatcgatctcggctttgcgccgctcgatctggatgatgatatacgggctgatttgattgatgttcccgggcatgcgcattatgtaaaaaatatgctcgcaggcgcgggagcggctgatttggtgttgatggttgtggccgcggacgaaggcgtcatgccgcagacacgcgagcatcttgcaattttgtcgctgttgggcgcacagcgcggcgtggttgcattgacaaaatgtgatctggctgacccggaaacgcgtatgcttgcacaggcggatgccgttgaggcgtttgcaggcagctttttggagcgtgctccgatgatatttgtttcatctgtcacgggtgaagggcttgatgacctgcgcgcgctgttggcacgaaaagcgagggaagttgaattccgccgtgcggaccgcccgttttttatgccccttgaccgcgtgtttacggtcaaggggtttgggaccgttgttacgggaacggtattggatggccatgctgctccgggggatttattgacgcttcagccgtccggagaggcggtgcgtgcgcgcagtatgcagagctttggcaaggctgtggagtatgtctctgccggacagcgcgcggcaatcaatttaccggggataccggccaagcaaattgaacgtggctttgtactgactgcgtccgcatattgccgtgcagggatgctgctggatgtacggctttatacgctcccatcgcagccgcgtgtaattacacacaatacacggttgcatctgtctgttggaacggcgtgcgttgtctgccgggtgtcgctgccgggcggcggcacaatccggccgggagaaagcgcgtatgcgcgtatgcgcctggaaacgcctgtagccgcgcgttttggcgaccgttttgtcgtgcggttttattctccggttgaaactgtgggcggcggcgtcgtccttgatagtgcgcctcgctttggaaaactaagcgctgccgggttggcgcgcctgcaaattcgggaaaacggcagtctggcagactgtatagccgatgaagcgtcgcgcgcgctgttgacagaacaagacctgcacgcgctgttttgggaacagtcggaaaatcaatggcaagctgcccgtaatgaactgttcgctgcaaaacgtattctgaagctggggtcttacatgctttcacagacgctgtatggatcacgtctgcatgctttgatactggcggttgaggaatggcatacggcacatccgcttgacgaaggaataccgctgccaatgctgcgcgagcgattcccagaggcgttgattgatgcggctatacggtcgggcgcgctcacgcgccaggggaacacggcggctctgccggggttttctccttacaagacgccgctttatatggagctttccgcgcggctgacagatatctatgaggcggccggctgcacgccgccggaggatacggctgccttggaatccgcagggattcctacggctgtccgggcgcgcctgcttgacctgctgtgcaagcgcggcgcgctggtgcgcgccgcgcccgcgctttgcttttcacaaagcgcgtatatggccgcgcgcgctattgcgcgcgcggccgggcccgccgggatcacgcttgctggtctgcgcgatgcgctcggcatctcccgaaaatatgcgcaggcgctgctggagcatttcgacgcggcggggctgaccgtccgggacggcgatacgcacatccccaaaggagatatataaaacgatagatgggcgcggatggacgccggtgtgtctcccggtcttcaaaaccggtgtgaatggcgcagaaccgtttgggtgggttcgactcccacacgcgctcgccaagcagcgcgcgccgggttttacccggcgcgcgctgtatacaataaagtaagcgcggcgcgatgtgaaggaaaggaaaccatgcacagccggcaaatacaggtgtttattcaggtcgcagacagcggcagctttgctagtgcggcagaaaaggcgccgagtcatgacgaataaacgagaagccggacgactattcatcgtctggcttctcgttgtcccattgcatttgattgtcaatgacagaattaacaaagccattgagactttcaccttgatttaaggacttgaaggagaacggctggggtggtataatgcaggaaaggaggtggctttgatggatgacagagtattgcttgaagcaattggtaagatgatggatgaaaagctggcaatcaacaatgaacagctccggcaagagatgaaggccagcaatgaacagctccggcaagagatgaaggccagcaatgaacagctccggcaagagatgaaggccagcaatgaacagctccggcaagagatgaaggccagcaatgaacagctccggcaagagatgaaggccagcaatgaacagctccggcaagagatgaaggccagcagtgaacagctccggcaagaaattatgcttgatttcaacacagtcattgaggataaagtctctaaggaaatcaggctgattgcagaacagcacagcgacatcgtcgcaagacttccatacgttgaggaacaggctgagataaaaagccgggtcagagttttggaacgtgttgtgagcaatctcggagcggaaatagacaaattgaaaaaagctgaataactgccaactggtgcgcgcggaacattttccgggcgtactttttatatcttaaaatccttatagggataattcttattgccaaccttgaccgcggccgctttgcgagggtatttggcgaagaaagtgtccaatgtgtccagagtctcgtctccgccatccataatctgatagcaaatcttccggaatttcttgggcagtttgacaacttccatattgacgccccccttaaaggtaggtaagcagctgctttggatcccggagggcacgaagaccgccttctgcaagagcctgcatttcattttcccctgcgtaggtcagcacaggagccagcgtgtccacccttttttttatcagcgcggtgaaacgggtgctgtgggcgatgccgcctgtcagtacaatggcgttggcgcgtccatccagcacgacaaacatggcgccgatgtccttgcaaatttgatacgccattgcgtcggttacaagggcggcaaactcatctccctgctttatcattgtttccacctcacgcatatcgtttgtgccgaggtaggactgcacgccgcccttctgggagatgaattcccgcatctgctcataagtatattcccctgaaaaacacatgtcgataatcgggccgactggcagtgagccgctgcggtccggagtgaaaggcccatcgccgcccatggcgtcgttcacatcgatgacacggccgtaacggtgggcggacacggtgattccaccgcccatatgcacggcaataaatcgcccgtcctcgtaggcaataccaagacttgccgccgccttcctcaccactgattttgtattcagggcatgaaacacgcttctccgttcaattcccgcaagaccggacagcttggcacacggctccatctcgtccaccaccaccgggtctaccacaaaggcaggaacattccagcagtggccaagatcgtctgcaatcagtgcgcccagcacggccgcatgttccttggcatgcgggcgcataagatccgctatcatcgcgctgttaatggcataggtgcccgattcaatgggcttaacaagaccgcagcggcccaccactgcatgaatactgcccggctccacaccattttccttcaaagcccgtgcgatatgtccggagcgcatatccttttgtccgataatactgccgcaggcatgcagttcatccgatgaatggcagattgtctcctcaaatcggcattcctcattgtcaaacacagcgatctttgtggaggtggaaccggggttgatggctaaaatacgtaatatgcggtcaatcattgctcatcctcctgttctgcgccgctgatttcaaaaataaagttccactcgcgcaagcgttgttcaaaccgctgcgcctcactttttgtaaaagcgattgtcaggctcatgctgctctgctctgaggctgcgataggggtcacgtgaacctgctccacattccagccattgcggcggatgtaagcggtgattcggctgagtacacctgcgcgatccttcactaccatggtgtaagtttttttcacactatccctccattattaaataaagccttcggtcacaggtgatggccatgaaccaagttcatccaagctctgaactctttttacttttgaatatgacggatatgctttcccatgtcattttaacaattaatcagtttttatctttgttattccaatggtatcactttctgtaaagggagaacacaataagagcgattatgatgcaccgcggatcggcaatgaatgaggaccacgcaatcccgtttacatctaccagccagtttaacaggaacatggcctgaatgtcaaacccgccttttcgcagcagcgacaggatacgctgctaggagtgatcatccagagcatatattccgtgcagcatcataacagacgtatccgtcctgagaatcggaaaaatcacaggacacaggacaaaaatcagcaggttataaatcaaagcaagtgcgccagcggcccaaagctgaagaccatgctttttttgctctgctcatacccaacgcccaagccgcaggaaaaaaggttggagccgccaattccaacagattcgccatggcgggtaacaggataaacagtgggattgtcgatattgccgctgccaagtgtcgggacgcatgggaaaaccctgcgggcagctttggcgtctatggaaccgctggatggcaaatgcttcaatagaataaagaaccgtatatatcagaattttgatatatgcggctcctgtccgcccaattcaggccgcgctgtaaattttaacatcaggatcggcgctccagagaggttttattccggcgaaaacatcgctctggaacatatctttggagagatacgcctgcgcgtattctacattgtcaagcctacgaaggacctggacatccttgtcacggatcaacagctccttggtcagggcgccagaaagcttctcgaggaacggaacgttatatcatgatggaaaatggataatgtttgagctaacggacacagcttcgttgaatgatttcattagattgctgaaaatcaaaagaaggccaaacaaaaagtaaggatactatcgaatcagctttagctgttatatgatacaaagtgggtgaaaaagatttcagagaagttggacttattgactatagtccagcccgggaggcgttggccaccaaccgaccactcaccagccctttctctatacactgccgtaccacttcttcaaatagccgtcgaaatatattccggaaggacagttttcgccgtcgcagttggctgatggtgctgtgatccagaacccgctcaaacagatccagcctcagataccaccgtagtgccacgtcggtctgaatccgctgctcgatctgccgctctgagggaatgccgtacagaaatcccaccagcaagtattttaccagcactaccgggtcgattggcggccgtccatactgatggctgtacaggtgcgcggtttcttcatatacaaagcccagatccaacacctcgtccaacttctttccaacctgctgcggggtcgatgtgcacaagtcatttctggcagctaccatcattaaaaccccggaaaacagcatgtagcccagttatcagaaaaaatgctattccacattcaactcagatctgaaccgcttcgccgactggctccatgggaatcactacctggatgtctgcatggaatccaccggaaagtaccgggtttctatcttcaacattttggaaaatggggtatctgtgttgtcatcgctaatcccaaatgggtcaaggctgtaaaaggcaacaaagacgataccaaggattccaaatggattggggatctctttcgtattggcttggtgaaaagcagttttattccagacaaggagattcgcattctccacaagttgactcactctgatgtctttgcttatacagatgctttttataacacattccgtccgcattctgcgcctggttggctctctcccgcacaatttggaactgcgcttacaccgtctcatgcagcctgatcgagcatctttacatatctctgtgtccatttaagttcccccctttttcttgtccgctgttccgggaagggttcagtgccggcctccatctgtcccaaaagcgtaagcgtgagcttctgctcgttacatagagcttttttgtgatctcggatcccatttttcatttttactttacagcggccaattgccgcttctcaacctatggggataaagatctctaccgcagcggtcagggcgatgtagactaccggatgcctgttgaactttaccagtaggtagtagatggcgacgaagagaagaatggctgggaggttaaagaagtcggccacctgagagatggggacggtcttatcgatgagggtgaggctgatgatgtcccaggcggcgcaaccaataagggcggccaccgccgggcgcaggccgtagaaagcgccttggaccagaggactttcctggaatttccggagcatcttggcgatggtgatgacaatgaaaaaggcgggaatagtggtggagatgctggcgataagggcacctgagataccggcggcgttgtagccggcgaaagtggccatattgatgccgataggaccgggggtggactgggaaatagcaatcatatcaatgacttcggtgcgggtgaaccagttgaaattttcagcgatatcgtagaggaggggcagggccgccagacctccacccacggtgaaaaggcctaccttgcagaattcgatgaaaagctggaaatagatcattccgcctcgccgcccttcttagtggagaaccggcggaggagaattcccacaaccgcagagaagacaatcaccggaatgggagagatcggggtaaacaggagaagggccagcaccatcagaaaaataaccccggtggccttgtccacgacccctttcttccagagtcccaccgctgcatggagtaccagggcgcagacggcgattcggataccggtgaaggcgttttgcaccacggcgatatccatgatgttctgcaggaacatggcgatgattataattatcaccaccgagggagcgatgacccctgccgccgcggcgatggccccggccagtcccagcactttgtacccaataaagatggaggtgttcaccgcgataatcccgggggtacactggccgatagcataataatccataatctcctgctcagtagcccaatgctttccttcgatgacttccttttggaggaggggcatcatggcgtagccgccgccgaaggtaagcccccccaccttggcaaaaacgagaaacagttcccacaaagtcttcataatatactccgttcagccgcaagcccccgcccaagcagcaaggccgggtggggatagggcgtttttaaaatatgggatatgggaggccgggaaagggcggtggagcgtccttttgagcccttcccgaaaaatagacagtaaaaagctttaaaaaacagatatggtttggaaagtatgccgacagattttttagtacgtcgatgactggatgcatattaaaaagtaggacaagtgtagtaaaataggagacaaagaaaaaaggaaggaagaaaagaaatgacaaacgcaaaagcaacgccaaaatacagcgaagatttcaaaaaaacaatcgtaagcctgtaccaatcgggaaaaacctactttgaaatccaaaaagagtacggggtttcttcgtcagacctctccaaatgggtctacaaatactcccaggttcaggtggatgacgataccgttcttaccacgcagcagatcaaagcccttcagcgccgcaatgctcaactagaagaggagaatctcatcctaaaaaaagccattgcaatcttcacgccacactcagacaacgattagaagttgtccaggcactttccaggcagcacaatatctctccatcctttgctgggtactcaatgttcactgcagcgcctattatcggtatgtaaaccggcagccctctgccagagagcaggagaatcagcacatccggcaaaagattctggagatctatgccaaaactggtcagcgcctgggatgccgcaaaatcgggttttgtcttgcgcgtgatttttgcacatccatcagtgaaggtcgggtgtaccagctgatgaaagaaatgaatctctctaaaatgtccactgtcaagccccccagacctcccaaacaatccgatgattctcaggctttccagaatctgctcgcccaaaaattcgatcagccggccccaatctggtctgggtctgcgactttatctatgttcgggttggccaaaggttctgttatctctgcgttattctggacctctttgctaggagggtcattgcttaccgggttggcgcccggctggaccgcttcctcgccctggagactctccgggacgctgtccgcaacagaggcgtttctcagggcgtcatgttccattccgacaggggcgctcaatttacttctgccgatttccgaaaagtattggattcccttcacatggtccaatctttttcaaaaaaggggcatccctatgacaatgccgttatggagtgttttttcaaatacctgaaaaaacaggaactggaccgtcggcatttccaatctctcgatcaattaaagcacaacctacttacctacattgacggcttctacaaccccgtccgccctcattctcacaatcacggtctttctcccattcaagctgaaaataacttttttcggctgacatcccttttttacgttttgtttccatttcctttttactactttcctttccgttatatcgaatcattttgtgtccatcaattcgggaaagggggcgctctccccgtctgacgcgccaaggggggggggatgacgctgggagatgtaaaggcccgacgcgggggatcagctcggatgccccagatcgcaatccaccacctggctgaagccggggcgagaaaggaccgttttccaaggacagatcatctggttgatggactggagctggccgtaggaatcaggtagccgccagtctccatcctccaaagagaagatggtgaggtccccaaaatacccaggaacaatggcccccagcaggggcagacggtagatggcggcggggacggcggtaaccttggtcaccgcatcctccaggggcatccccagggccataagcttgctcataaccaccgccagggaccagaccggcccgttcatgttggcgttgtagatatcggtgctgatgctgtcggggataaatccttgggcaaaggctctttggtacactggccaggagaagctctccctgccatggcccacatcgatatagacgccgcggacccgggcggccaggaaggcctccttgggggcgccgtccgcctcatagggggagatatccttgccatggtagctgtgggtcaccacgtcccctttccgcagcagggagacaatctgattggggtccgggggaaaacggccgatgtggaccatcagcggcaaattcagggcttctccgatctccaccgcgcgtttcaccaggtcgtagctttgggtgccggcaagggaaccgctgcaaagacatttaagcccctttaccagttcggggtgggcttccttggccgcccggaagtattccagacggatgctgtccaagtccagaatcttatggtgcgggaagtcgccccgagtgacatgacagttcagcatggtgtaatgccgggtcttttcctgagttacctgggcagcgaagtcctcgatgtccagtgcggcagtagttcccgcctcaacaacggtggttactccccgccggcagcccaaatcgtctgcatcaggggcgccgtcggcgattctccgggtttctccccgggtgtggacgtgaatgtctatcatgccaggggatatgtacatcccggtggcgtccagcaccgtggcgtcctccgccgggagatcgggcccgatctcccggatcaggccatcatccagcaagacgtccaatttggtacggaaataaccttgagcggggtcaatgagagcgccgcccttcaccaaaagtttgttcatggcattttcctttcttcccggctacggggttagaggaggctcttgatctcagcgtaagccttggcggccagctcggaccgtgtgagcttggtttccttgtcgatgatggaggtatagatgtgggggattacccgctcgcagccggcgtccagacagatcttcactacttcccggacattgtcgggggagagaccgccggtgggttccatgacgggaatgccggccttgacggcggcggcggccaccgacttcaactcctccaggtgggcggtaccgtggatgtcatagaacttgatggaggagagccccacgtccttcatcatggccatggccacgtccacatccaccaccaggtcggaaccatggcaactgacggggccggtggagatcttcacctttcccgggatgccagtggggctcatgaggcagttcaccagggtgtatttgcagccggcggcgtccagagcgccctggcagtacatggcaccggtgtagacctcgttggcgtgaccggggtcggtctgggcagccacctcggcaaccatcttccactgtttggggtcgccagcgcccaggcccacggaaacgttggtgagctttgccatgtaggcctttacatcagctacgcaggactcaacggtggagtagttcttggtaagaatccccaccagaacatggccgtccagggcctcggtcacttccacagcgttgtccagatcccgggccagcaggttgatcatcactttgtttttatagaaatccagtctttccagggtcataaaaaatcctccgttttctgccgcccccgccggcggttttttataaaaaccttccgcaccgggggcaacggaagggggaaagggtctagccttccaaaatcttcttcattttttcggcaatggcttccacgtcgccgggaaggatgggccggggatcaaagaagatggtgcccacattggcaaagtgatcccgggtatagatggcgggatcaccgtccttcagggcggccacgatctccagagcggtgagggggcagcttgactccacatccacgcggcaccggctgatgttccggcctgcctcgtcccaagacttacccacttggatgtggggcagcccggtgagggcatggatcatctgatccaccgtggcgttgagttgggcttcatgggctgccatatcccgtccggtgtaaatctccaccgccttcagcaggcccatcatgctctccttgccaatcttcatggaacggccgatgcccttatagtggagcttggccgcatcggtgaggtctttccggccgcagataaagccggaggtggggccttcaatagccttggcgccactgtaacagaccagatccgcccccatggcgatgtatttcttcaggtcctcctcggcagaggcgtcgacaatcaggggcaaatcgtggccgtgggcgatcttgatcatgtccgccaaggagaccatccctttctggacacaatggtgggatttgacatacatcagggcggcggttttgtcgttgatggcgccgatgatgttggctttgtccaccttgttggcgcagcccacctccacggggatagcgcctacggtgcggatcatctgggtaacaggggcgccgtaattgacgcaatgccctttctggatgatcacctggttcttcaggccggtggtgtcggggatcttctccaccagatccaggttggaaccggtcattactgcggcgatggaaaggcagatggccgcagaggtgttggctgtgacacaggtgccatcggctccggtgaaggggcagagaagctcgcccacccggtcgatgagttcgtcgatgaccacgtaattctgagcggcttccaccatggttttgccggtttcgtcatgaatggtagaaactccaagggcggtcatccggccgctggcattaataacccggcgcaggccggctttttgataaattatttccataatagcctcctggtttgttgaattcgctacatattatagcgtatgtttggcgaaaatggaaaatagtgtattcgccggaacaaccgcagcagtatagagggcaaagctcatcccgccccctatactgctgtgagaaagagctttttatgcggggatggggaataggaaagccaggaacatagcgcccaggatggcgccgccaacgatggccttatccatcttgaagaagatagcggcaccgatgatggagccgatgccagcggggatgctgtagctaatagcagacaggatgatcagaggcccaaggtagcggccggtggcattgccggcgcccatcatgatgttggtaccggaagcagccattccctgaggcatggtcttacggacagcgatgatgacgataccgattaccagaccgatgacagcaccgctcagaagggacaggacgaagttggtcaccagcatgtcaaggcccatggacatgaacagagcggtgaaaccggtgccgacaccggtcatgaaggagccgccgatatccataataccaaccagagggccttccatgacacgagccagcaggaatccagcggcataacccacaggggcggcccagtcgccggtagccataccttgtttaatcatttcagcgtgagcgatttcattgaaggaaccgaaaccgtgagtaataagcatgtgaccaccgccgatcatggtggcgcccagcagagcagtaagaatggggaaagtccagtcgctcaaaagagccttacgcagtttatccatagttcaatctcctctctccgattaacccaggaaattcgagaacgcggcgatgaggttgccccaaaaaccgcggccgataccgataacgatgaacagggcggtgataacagccagcatgattttgacggttttgttgtaaccgttgtctttcacagactgaccgatgatgatacccaggacgcagccaggaacggcgttacccatgatgaggtagccgagaccgcccaggatagtgccccagataccagtggtcttaccggcatccagcgcggcaagccagaagataatgggcatcacagtgttgatcatcaggttggcggcgggggccaggataccgctggcaatgatagagagggattcggggatggcgttggcgattaggttcagcagagccacggtgatagcaccgattaccgcgcccacgacgcccatcttggcaggatcctgaagggtttcttccacatttttgtttttcacaaggagaaagctggcagcccagttgggaacgatacggtgcagaacatcctgagttaaagcaccggcgccgatgacggcgcctgcagcattgaagaagaagcccagaccgaatgaaaagtgggcaacagggtcgcctttgcaggcgttgagttcgcccagggtccggaaggcacccatggcctggaccttaggggcatggaacattctggcggcacccgcggaaaccgcagcaccgcccaatgcgccgataatcagggacttgatgagaacctcaaagaacatagtacctctcctctcgcgatatttgctgccgggtggatcccggtgagcaagcggtcgaaagccgtcaaatgtaacggatggtgacgatgaccttcagtttgatgtaatagtcttggattcccttgggagcaaaaaaagccaggaatttttgcactttgtttttttcatcttcggcaagaaggataacatcgtcaggctccatatggatcagcaggccgtttacagagttgtaggcctcttttttcagcttggcgaaaacggcagcgacggcatcctcccgttttttcccataagcatccaggacaaattccttggtgattgttttcaagcaggattttcccagctgatccatctttatgcctcctctttcttccaattactcctgatcgggctggccgtggatctcgtagtaggcctccacaatgcgcttgcccagttcctcgatgtccatgaagccgaagcccagcacctggatgccatcctgcaccgcagtaacgccctcatccaccgaacgcatggagtggcggcacttatagccgtacttgttggaggccatcagggcgccagcgccaccgctgccgcagaagctcagccccaagtcggcgtttttctcgtgcatgacgtcgcccagtttcatgtcggcggccataccggggatgacataggcctcgccgccggctttttggatgccgtcggcaacatggttgcccttgcccatccgctcaccgatcacaataacaactttttttcccattttcgatacaccccttctctttgttgttggctgctgttttgtgcttattgccgctggtgcttctacgcctttttcatcttcatcatggccgcctggacatggatggtcaccaaagccagctcggagtggtccaaggtgattccataggccttctcaatgggttccagtacctttctggaggcgttcagagcgtccttctccagttgggagaggacatcctcccccaggtcatttaccttctcaccgctttccagccgcttcaccagattgatggcgtgggagatgaagccgatgccgccgttttcgtcaaaggcgaccccttcccgttccaggtcttccagtagggctgggacgtgtttttccactgaggcggagagttccggagtcagttccatcttctcctccacatttttcactcggtccaatgttgtcatattattccccctcagtttctatagcaatcagaatttcagcatctccacgacgccgccgacaatggcgcagtcggggcgaatggaggtgtgcccgatgagatcgttgccgtcggcatcgtggtattcgtagttgccttcttccatgtggaagacagtgatgtcggcggtgtatccttccttcagctttccgagacccttcatggagaagatggcggcgggagcggcggtaaccttctccacacagtcctccagagagatgcccagggccaacatcttgtccatggtcaggggcaggctgaaaacaggaccattgatatttttaatatgaaggtcggtgctgacgatatcagggataacgcccagggagaaggcggccctggcggtattaaaattgaagctggcgacgccgtggcccacgtcgaagaaaacgccccgatcccgggcagcctggacctcgggcttgatcttgccgttttccagcaggccgttgatcttgccatggaaagagtgggtgatcatgtcgcccttctccatcaccgccagaatctcctcaatatagggaagcggattcccaatgtgaatgtaaaggggcagtccgcaccgcaccgcaagtttcttggcctccttgatggggccgatgcccagcttgcccacggtgctgttgctggcacgggctttgatggctacaatgtagtccttgtgcttgcgataagcttcctccgccaaatccagatcccacttggaggggtcgtcggcctcgggtttgataaagagtcccttccgggagaagtgcatctcggagaagatccgggtcttggagggtttgatgtagttctcgatgaactcctcaatgttctctgggccggcggtaccggcgtcgcagatggtggtgaccccgaaggggacgccgatgctgtcgggttccacccccagatggcttccggggaagacatgggtatggatatcgataaagcccggggaaacgattcgcccgcccaggttcatcaccttcatatctggctccacccggatctggccggcgattttttcgatttttccgccgctaaggaggatgtccttttcagccatcagaaggccttcgcttttgtccagtagtttaccgccggtgagaagaatacgatccataagataaaaccttcctttccctatgatcatatgaaatagcgcataagcgccaaggcttccttgtcagggatgtgcaggccatattccgtggaaatctcccggagttgccgcacaaggtactcataaacatagatgttctcatttttgtactgttcgctggcgtattcccggtcggaaatccctttgcgccagcggggaaaagacatgaggatgtggataatcatgccgaacagcttgtcgttggaaagctgaatcccgcagtcccgccccagttccatcagggcgctgctgatccgggccagggtcatggagcattggaacatgatgttttcctcggtcatctcccccagaggctggatagcttcggagtcggtgaagggggcgatgctttccagctcccggaggaaacactcccgctccttggggcgaacgtaccggtctgccagttctgcaaaggagtattggaaggattcctgcccggcgtcgttctcatggatcctgggggtgctgaggcggccgttgaggtagcggttgatccggtcgatctcggcggcgctgatgatggggctcacctggaataccggtttatccagaggcggcattttcacagtgctgataatgaaatccacttcggccaggacatccgtgttcccgacgtctagagccgaaagggtcccttggatctccagacgggggatattgttgcgaatccggttctggagcacgatggcggcaccttgtccggtattgcagacgataagagcctttttgctccgtagccggttgcattcctccacgttggcggcgatgtggatggcgataaagccgatctcatcctcgtccagggggatgccggtacccatctcaaacacctgggacatctggtgcgccaccgcaaaaatttcagggtagtttaccttcatctgggccagtagcgggttgggggagggtatctggagctggtatttcttgaccgtgagcttcagatggttcataagattcatcttcaacttgtctcggtagaaatccggcatgtcgtagctgggataggaatggagaacctccaacatcttatctacaatggaagaaagacgttccgccagtttatcgttggtttttgggggaaacctgatattgcaggagatgagccatttggaaaggtgtgccgcttctctgctccccagatccaaatggaacctggttttaagcctgtcaatgagaagggaagccagttgttcctcccgaggttctccctggttcccggaaggcttctctcctgagaaacagttcccaccgcaggctcgccggactaagactgcaagatagaggagaaggcggatatagccgtcctctggcatggtgtggtaggtgatctcccttgcgtagtccagaagccccgccagagcgtctaggtctaccgccgccagataatccagagccagggatcggagtgtgtgctcctcccggcagactccccggaccacacggttggtgagactgtatcgggtgatggcgtggctgtcgtcggtaagctggatcaaggcctccaccagacaggcacggaactcctcttcacagccacgcaggcggtagccctccccctttttgctggcgatactcaattgtcttacccgtaactcctcccgcaggctatggagatcgttggtgacggtgggggtgctgacccgaagaaaggacgccaggtcctccgctttaatggcggtttcagaaaacagcatatggtagtaaatggactcccggcgctcctccggggaaagaatctttaccaccgcgccctctccgtaaaaagaggagagttttcggcggacatcctcgccaccccggatcattactccggcatggggacgctttaccagctcgccgccttggctcttgagccagatgcttaccacttccaggtcgtagcggatggtgcgttcgctgaggctgaaccgcttggcgatctcccgtactggtacacaggcggtcatgccgctgaggtatcccaaaagtgcctgctgtcttctggtaagctggatcatggaaacagctcctcgtttcatttttgagaggaaggcgcaggcccctcccttatttaaaatgataatcgataaataggagagacacaacacaagaattcttcacccctaatgttgcaaaactttacattccttaaagaaagagttcggggttttgtaaagagatggaaaatatttagacggtttaaccaagaacaaaaagcattcctgataaaaaatgacgggcgcattgcaatatttcaatgcgcttttcaaaaaagccaatcagatgatactttttatactaaaattttcacaaagcattgtctgtgttgtacaagagcgggattttccccagacgcaagggcaaaaaacagggggacttccttattttacccatgggaagaaagattatcgctgcaatgggcaggtcggatcttccccgaggaaaggtatcgggaaaaagaaaaccaaacagtcacgccccaaaaaaagggggacatgaccggattctgtaagggcttatgccagaactccacgaggtttttgactacaccaccccaaaggatgcttgggcatactacagacggatcctctattgactttgggacaaagtcgaagtggagaaagttcaaagggcggtacctgcggggtgccgtcttttgatatttccccacgggacaagtgggaaaggctggcatatacacgcactttcgcaaaggaggttttcaatgacgcaagctgtcacttatgcttaattctcgcttaatccccgtgcctcctcaaattgagcaacaacgaatttctgttaaggccagagaactagtcagtttgatttctaatatcgaaaacgataaagaaagcgttgttggaatagtagccaacgcaaaatccaaaattctcgaccttgctatccgcggacagttcgtcccgcaggacccggctgacgagcctgcctatgttcttctggaacgcatcagagcagagaaagaaggaccttattcgccaaggcaaaatcaagcgtgataagaaggaatccgtcatcttccgtggtgaggataactcttattatgagaagattggaaataaggttgaaaatatcgacgaccagataccttttgagctaccagttggctgggtctggtgcagaggtcattcctgcttcgagagcatggagagcacaaaatcgcaaagtgagttctttaattacatcgatattgatgccattgataatcggctccatcgaatcaaggccgcaaagcatctcctggtatccgaggctccaagccgagcgagtcgagcagtaaagaacggaagcgttctgttctcattggtcagaccgtatcttgagaatattgcactcgtagaggaaagatatagtcactgtattgcatcaactagtttctatgtttgcaattccaacggcgcattgttacccgaattcatgtatttcctgatgatatcaggttatgtggtcaacagtctaaatcagtatatgaaaggagataattctccgtctataagcaaagacaacatcgaaagttggctctacccaataccaccgctggatgagcagaaagtcatatgtaccaagttgaatacaacgtttactctgattgagaatgtaggaaagagcctcagctgagtctcttttccatttggttgagttcgaacagcgtcgcgtcaatcatttcagttattttgcgttgttcagatgctggtgggagtgggacaacagctcgttttagcatatcttgtgtaagctgattgatagcggtggagttgctatcatcgaacacacttctaaagaagcttgaacgaaggtgttgcacgatatactcaaaatactctgtcctatatatcgccataaatgcgccaaatgatgcagcctctcccaaatttgaaattagcgcacatttaccaacaagaactctactcccgtttcgggcgcaaatcaagatatcattcttctgtgcgtattgattttttctgatggtggttttaacacgaaccaagtcgcttaagtcaattgggtcattgacaatgttgcacgaacgcaatactataaccccatccggttctatatcggttggacgatatgtgaggccaagatttgttgttccgatcatagaaaaattgcaccactcccaaccatcaggaagctcaaaaggaagctgatcatcaaggcaatgtaacttttcatcagccatcttctcataataagagttatcctcaccacggaggatgacggatttcttcttatcgcgcttgattttgccttggcgaataaggtcttctgtctctgtctggattaccgggagatctccctctacacctatctgctccggtgcgagaaccgtgaaacctaccagtgctaccccagctacaagaccattggcaaagcaatagtaacgcatcatcccacgctccgcttcctccggtagccgttctctttggatcgccgccaggatgctgtccgcgtattttaccgcctcggaagcgcccagttccataggggaatcctcccagtcacccattggtttttttcatagaggtccacggtcatgggtatatacagcttgagcagggccggcttatgtggcaggacggtaaaactgtcctctccaatcaccagccccagtgtgcgtccattgtcccaccggcagtggaaggttcccacatcgtcaatggcctgcaatgtgcccagcgtccccagcgctaccgggtggtatgggtctttcatctctctgagtcgaacgcggctgccaatgggaaactgctcctgtagaaatttcagccattcctttggaatattcatctcatgccccccaattcaattttctcatcctggtcatcctcgttctccccaaaatcatcttcgccgtccaggtcaaagggcggatccgcgaatagaatcgtatcggcctccagatcttccttcaggttgtgcagcccattttcagcttcccctatgggaaaatacatccatttcccctccagatcaaagatatagctgtattccacgccatcggtttcccaatcgtccagctcatccagggacattatgcgggcgccgcaatctgtcaaatcttcgtccctttggtatgcgatggtcacctcaggctgcgcgtgattggaattatggggatattgcgggtcaggctccatcctcttggagtgatataataaaaccgcacacctaagggaagaaaggacgagaggaaatgggacaaaaatacagtgcggaatacaaggcagatgtgctgaagctggcggatgagatcggggtcagagcagcctgtgaacatctgggtctatcaacaaaaaccgtgtataactggcgtcgggaagagcggctgaagcacggcgaattacgcggcgtgcagccgggcgaaacagcggagcaggcggtcgagcgcctgcttcgtgagaacaaagaactgcacgaggcaaattacatactccgtaaagcgctgggttttatggcgggtcgataaccggtgtacgtccgcgggaactgtatgcatggatcaatgagcaccatgacggaatcagcatcgccctgagttgtcaggcgcttggcgtgcggcgggaagggtattacgaatggaagcatcggtccatgcggacagacctcgatgcacagctgatatcggccctgagaaaagcgaggaaggaacacccgtgttatggcgtgcgcgggctgcgggagactgtggagcctacgcttcgcgtgagctacggcaaatgttatcgtctctgtaaagaaaacgggctgttacaacgccaaaaacatccacatggcctgacaaagtgcaatcatcgtgacccacagagtgacgatttggtgcagcgggattttaccgccaggaagccagacgtcaaatatttaagcgatatcacgcagatcgaatgtgcggacggcaggctgtacctggccgctgtgatggactgttatgatggggcggtcgtcggcttctccatgaagcatcatatgcgtgccagcctgtgctgcgatgccctgcgcgatgcggtttcacgctatggttatcaaaagggtctgatactgcactccgaccacggcagccagtacaccagccaggaataccgggcggcgattgcggagtttggttccatccggcagagcatgggccgcacgcattgctgctttgacaacgcgcgcatggagagctttttcgcaacgctgaagaaggaactggtctaccggctcgattgctccaccatgaagcgggatgaggttcgcaagatcgtattccgctggatcgagacctactacaaccgccgccggcgcaacactgccaatgaactgaatctcccgccgctggtcaaacggattcgcttcgctgatcgtccgtttgccgcttaaggttttactcatgggtgtacggttttcttgactattccatctctccaagcgaatgcaggtcgcccagagccagcagccggtcaacctgttccggtatgttgtagtgatctgcaaggacttttccgttgtcgtcagggtatccattcaggtggcagaagatagtcaggtatggtattccagcagctttctcatccatttttctttgggaacatacagcataacgcgtccgctgaactcccgctttgcaactccctgttcgttgtatttgatactgttgttgcgggatatacaaatgccataactcagaaaccgggcaaaatctgaggagtgggtgactttcgtctttttctcagacaactccagtttcagggtttccgctaagaaattcttaacatatccatctgtgttacagataagctccagagcaaaatgccgggcgtccagccgctccagctctttggtgggggcgcgccctccatgcagggtcagatagtaattccacccaatttgttccagatcggagaagtcggtgacgactgttgtctgctggcagcagaaggtcaggtcgatgagatccttgatcccactgctcccgaactttaccgccgctgcctggaactgcgccgcctcctgatctgtgaagctgttcagacgctttgccagatagtccagctcatccagattcacgcgcccgcccgccagtcgtctgaggatggggcaggcgctgtccattttgctgattcggcagtcctgccgcacagcgtcccctagctccaacgcctccaactgctccaaaatgggttcatactcattgggcggaattgggaaggggacggctgcctcgccagattcttcatgctgtggatttttgagaactgcgttgaaaatcattgctttacctccgtttcttaacgacacacaatactgaaactgtgaggcaaagggaatacccaaacccaccacttttaccggcccatctttgaccgtcagtgccgctcggtcagctcctctacatcggtgcgcatacagctgccgtctttcccccagcaaaataaaaccatgatgggggtaggggcaaccctcgcacttatgggcggtctgtccgacagtcttgccataggatgcggggttgttttgctctgtatttatgtcgattacctcctccaaacgcaaaaaagcgccggggttttatctctagaaccccggcgcttacaaactcatgttgatttcgttttgatcggattggcgcatccgctctcgtggatttggaacattacgctcgatctggcggcggatatcctccagcagtagctggcatttgtccccggcataacaatgattctccttcctctgtaactttagcgccctttttcggaaaatgaaaacagcgtcctttttgaaaaatctcatttcaaaaaggacgctgtggatttctatagaattttggggttcggatccagccagcttctgtgaaccccctgtttggatcttttgttttaactgtgaaatttgaggtgccccccccccccgaaaagcccgataccatcggcatttctgccgatggtatccaaagtgggcatttttttggtggagacgaaggggatcgaaccctctacctcttgaatgccattcaagcgctctcccgaaccatcgggtatgcaccccctgatggcttgggaaaggacttgaatatcccgccccggcaattgatgagagacaaattgcagtatagcatggaaggtatatgttgtcaactggccatatcaaactttgatatgtacccctcgccgtggtcgtggcgagggtgagagcttattgcgccatgggcagttcataggtagcgcattcgttgatgctgtcgataccattcaggaactgctccacattaatgttgaattcaatcttgaccctatagtcccggaacaccgaaaccttcttgatgatgtagccgcagatcattttcttgacctccatcgggctttcatcgaaaatcttggaccaggacacgatccggttgaactcggccttcatctcctcgatcttagagtttccatcattcagttcctcggtaagggtcgtgattcgttcactggtggacagtaccttctgtcgggtatcctccagcatttcagtcagcacatcttgcggcagggcgcttttcccttgaatcgctttcagcacctcggccttgagggattcatattccttattggccttggtgttttcggctctggcccgctgcaattccgagcgtatcattgccatctgcttttgaaccgcacttcccacaatcatgtcgttggaagctccctgcatcttgtcgaagacctgatgcaacacctcagtgacgatcccgtccagaatgtgtattgtgtatccagtctgtcctgtacattcctgacggcgccgggtcttgttatagcatacatagcgaatacgttttttatggaccggcgtcccatccgcaaggcgggtggttgtcccgttggtagtgagcaccagtcggcctccgcagtggccgcagaagatgttcccggaaagcagggattggcctgcggtattcagcggtactgtgcgccgctctttccgctcattggtccgctccagcatcagcttctgcgccaggtcgaattggtctggggcgatgatctggagggcttcaaaggggccggcataggtttctccgctccgaaggattcccttgtagagcgggttgtgcaggatgcctcccacactggcatcgtgccagttttgtcccttccggtttttgatcccgtggtcgttgaggaagttagcaaggcgccatctgccgtaaccggacgaaatgcagagatcaaacatcatccgaacgactctggcctcatcctcatcaatgaccagcatgtacacctcatgtttgcgcttgttgaggatgccgctcttttccaaccggtacccgtatggtgcgtttccaccgcggaaccggccttcctctaccatctggccaatggccgttttggtgcgcatcgaagttttctggctctctccatcggcctgccagaaacggatgtagttggtcaggcgatccgtgtgggattcaaaccgctgttctccttcctgtacgctccagacgcggacgccctttttagtaaaccactccacaacgaaaggggtttcgtctgacttgcgtcccagtcggtcgaacatgaagacgagcagaatatcgaacttgccctgctccgcatacttcttgatgagctgcagtttatcacggtcatcggcgctgactttatagccggacacgccagtttcctgctcctcgcccacgatgacccagcccattttcgccgcaaaatcgtggcaggcttttctctgcatagggatgtctgcctggttgttttcatcgtgatcgacctgcttgttggtggaaactctgtatagacaataaactctttcagccattgatatccgtcctctcatgtttttgtgtgagagggcggacacccaatcattctattcgattatcaaggttcccagctttcgccatatccattatctcacactacggccagaatagccaggggaattgataatctttttggaggtaaatctgcagtaaatgggctggtgtgttgggttatcctgtactttgctcaaagtttttgggcctcatcagtctgccaaaagcgaatgtagtcaagcatgcgttctgcatcaacgccgtctatgatctctccctcatagacgctccaaacatggatgcccttcttggtaaaccactctacgatgaatggggtttcgttgagattgcgtcccagccggtcatacataaagagcagcaggatatcaaactcaccctgctcagcagcctttctaatgcgctgtaacttaacacggtcatcagcgctgactttatagccggacacgccgatctcctgctcctcgccaacaatgttccagccttttttctctgcaaaatcgtggcaggcgttcttctgcatgagaatgctttcctgatccttacctctgtataagcaatagactctttcagccattttactgaccatcccttcatcaaatcttctgaatgcaagaccttcagcaagtcgttctatttttggggcattgcataggaactcagaagtgcctgctttaccaatacggcaacttcaaggttttccttttctgcaaagcagagagtgaccttatagccctgaactgtgatatgcatttcaggcttttcctcatcgattctgagtatcctgttcatcgtaatcctcctaaaaataaagcatcggctattctaaaaagatagccgatgcttctcaatttctaattgtagctgcttagtggcgatagtccttttacagagtaggttcgattgactgagtaccagtttcctgtgcttggacgatgtccaatgttggcagagctttcagataattctctacattccagtattgaaccccattttccatctgcacatcttcgccacggtacaggatatagcgtccctggatggagccaaatcgccgttctgtcctccggcatttatcctcatcgacgaggtgccggtattgaaggggaacttgcttgctgctgtgtttgatttcaaagatctcacagcagttttctttctggtcatagatgaccatgtcaaactcgccagcctcaaactgcagtttgaaaacacggtgatccttgtcggctgccttcatggtttccagcagcacaatatcttccatcatccggccgcggacttcttcaagaatgcggcccgtgatctgcgttttatcatattcgctgagcgccgagaaccgctcatctttcagcagagaatggacaagggcctgagtctgacaatatcgcattcctggctgtgtaaagagaatatgttcttctggttcaatttcgggatctgctgcctcgatggggcaattcacgatcaactccagcgcggagagatactgcttgatctctatgatgtgggcgaccgtgatgccgatggactgatcctccttgttccggatatccagcagttccatcaaacgccgggtgaccgcctcagtgtcaatggtatccagaacctctgtgcgcttttggggatcgcgctctttccgcaggtttgcagcagtgagccgtaggtcgtgagaggcgaaatcacccgtcagcaccgagatcaggaaacggtggttcatgtcctcaatgattcgattaatggctccagtcagttctccggcttcgtataaagagtacagatggcggaaatgtcctcctgtctcatagcaggccagggagtgctggatgttcttgcagattgccgtgtcgatgtatcttcgggtggactcgtcatcccggaaggatgcatcctgagcattcacatcttcatcgtcaaaggccaactctccggcgcgtagtgtgccgccatatcggatgtactcatcaatgctgtcgatcccgagcagacggctatactcccgatatgggatgaaggtcgtgtggatggacttggcccggtcatacaattcttcatccatcgccagccagaagcccagggagtcggtaccggacaggacgatcttcattcccatggtggcgaacacatcggaaaagagggcagccgagtcaataaagtcttccatcagcgtgacctcgtcaatgaacacatatcggaatcctgcgttaaacaactttttgagatcctggttcatcatcgccatgttgtcagtcctgcggactttgatgtatgcggtacggctcaagtcctcctttgccattctgccaatggcctggcggagcatggtcgtctttccggttcggcgcagcccgaagatcaaacagacgcggtcgctctccttgctgtagaggtactcctccatttgctcaaagcaatcacgaagtccccaatcctttacgccccgcgacatggcctccagacccctgccggcaatcacgctggtttcaaaatccaacttgggctggcgcgctttcggcatgccggattgcaattccttcagttgagcttgaagggacttgcgccgatcaatttgttcctgcaatacctccatctctccatctcgaagatattggctgtgcttttttctgttctctgtccactgatggtagtatcggactttgccgttgatcgtcttctttgagatgtaaccaatcggcaggccggcgatctgcctttccaattcctgaatcttttcctgtcgtttcaaatcatccatgtcgcacctccattctgctgtattttattataccctataaccccaaaatgttcaaggggttataaggggttacgcactcatggtagattaaagaagcccacgaatgcactcgctttccagttcgacgatgtcgcctatcggtatccttaagccatcagccagaatcagtacctgatccgcctcatggattcttttcagcctcccggttgatacgatataccggccgccgtctttcttcgcgtcaggctggaaccaggtcaccgtgatttccggccgctctttgatccgctccaacagcagttgctgttttaagtccaaggcagccctggcatcctcgtccagttccatgcgctggtcagtcagccgtgccgattccgcaagggcggcgctgtggccggacagggccgcaaagggcgcaaactgggccgcacggtccgagagcggcatccttggatgcttggctgaggtagggtgcggcaggttgatgatatcgtcataaagtgcccaccagggccatttgttggccctggtggggatgcatatggaaaagatgatcaaagttcgatccttgatttgctggtcaaacggctataggtggcagtctgttttacatttccctacaggaacagtttttttgtgattgtacgaagtgtgtcacagctaagtccagtaccctcaaagagcatgaaataggtcacggcttgtagcacccgataaaccgcccattccttttcacctaccggatctatatcaccatgtgcgattttattcctgtatttactgtatatttccccataggaatttaactctaaatggaactctttttcgttggctctcaacaagtcgctaagttcttctttgtatttttcttttacaatgaaatcaacaatttcttttaagagcccttcgtagcgctcgacttggcttatgcagtcattaagatatttctgctctcctttgctcatttgcttttgctcgatattattcaaagccgtcaaagctaccttcttcgcggtccgaaattgctctttcttgttctgcttgaaatcaggatagcatttcctgaacaatccctcaaaggtcgttgctttcaaaagccaccggctggcatcgactcgaattcgttccttatagtttttagggaaataatagcataatcttttatcattttctcgaagacctgcaatttttgaaaacacagtttcaagcttatccaaaggtatatcgtctactgttatcgtgttcggcggtgacttcggcaggtattctccctgatctgaaaatatataagcatcggcacaatgggagaatccggcttcggtccttttatataatacgattttatcaaaatttatattggtttcataattgatgaaagacaggaaatcaaataacgccagataatattgcggtaattcttcacaagactgcttaatgcctgatttgagctcaaatgaaaaaacagcattgatattaccaagatttgatttacccgcttgggttatcacatagcgcgacacatttaatttgcatgtgcattctttgtagtcaaacgaaatctcagtctcatcaaacggtttgagctttattgccatactaccgtcccaactcttccaatcaaaatcagtcgatattgccctctgcggaggatagaaggagtttagggcatccgaataaaatgataccttctcaaaggtgaaatcatatggattacctatgtttccactggacaaaacatatcctatagggtaaaaccatactttttgatataaagatgagaaggagaatctgcatttaagaaataaaatctgcctgttgtctgaagtaacaccgaaaatagatttttcttcatcgatgttttgaaagtctctacagcattcccatgcggcaccaacgatgttaactctgcgcccctcaaggaaaaaaggatatgatttatccttgtgctttattgaaccataaataattgatgacatatcccttactccttcatcttcgttttgttcttatctcttgatttcataggagatattcgagcgctgacactgaaaattttctgttgctataacagtctgatgaaataaaaagttgattgtaccggatctgtcatttttcagttccattctttcatcagaagaaagtcgcggatattccggtgcttgatcccgttcctgctcatgtcaaactcgtcgagggatacgacatacttggggaaattgtcctggatgccatcgtatgcaccgaactcccgtttcacagtatcttcagaggccagcaggtatgttacctgcacatagagtttttctcctcttttttcgcatacaaagtcaatttctttttctcctgctctgcctactgtgacaacataaccccgtcgcagcagttccatgtagacaatgttttcgaggatcaggttgatgtccttcatgttcccgccgaacacagcctcccgaatgccgtgatccgcaatataatacttttcgttggaggccagtatctgcttgccctgcaggtcttggcgctttacctgatagaagagatatgcgtcacagcagtaccgcacatagttcaggatggtttccgccgcgacagtccgctgctcatttttgaaaaacttagccagagaggacgctgagaaaaccgttccgacatttgcggtcatatacgcgatgatgcgctccagcaaatcaatatcccgaatcttgttcctttttacgatatccttgagctgcacagaattgaatagatctgtgagatactgtcgggagggttcttcctcgtaccggaggttggccagatagggcattcctccggccagcaggtatttttgaaagcattgctggatcgaatcgcttggtgcgattgtgtggtacagttccaggaattcagcgaaggagaatgggtaaatcacaaactccacataccgtccgccaatataagtggccagttcaccggacagcagttttgcgttggagcccgtaatgtagatatcgcagtccagcgccacccgcaaagaattgacgcacttttcccagccctctacttcctggatctcgtcaaaaaacagatacgcttttccctcgatgtcctctgcccgttttatgatctcatcgtgcagagccgttgcggtctgcagatgggagtaccgcatatcttcaaaattgattgagatcatctgagacggggcaacaccagcctccgccagttcctctttgatcagttccagcatcaccgacttaccggagcggcgaatgccggtcattaccttaatcagctcgcccccaataaagggacggatgcggttcatatacagttctcgtttgatcatgattggagcgcctcctttctatcgttgattttagtgtatcccatttacaacttaaaatcaaccgatacaatctaattttatcaattataacttataaaattggtcgtatgttggtgcaaacactgtacacagcttttcaattctctcaaagaggtcctcggttgatcctgaagccaaccgcaatgattatctgtagattgtagtgcttcatctggcggctaacctgacggtagccctcagtttgaactatccgaaaattccggatagttgtctcctcatacctaatacaactcggagatgctctcccactggaggatgtatttctgatctatgattcgattctcatggtaatggccgaaaaaccagtaggcgaatttacaccgctggctgaccatttcaagaaagtccgtcagttcatccgtcccataggagggattgattttccgcaccacactgctgggagcgcagtgggtgagaacacagtctaccgtccagttgacccgtttcaagtttgccagggcctcttggtactccgcttggctgggcatctcctcggcccaccagcttacccccttgacccgaaacatggcccgcatccggcgcatcagccaatactggcgctcgaagtctggagcggccggatcgaggattccatcctgaatatcatgggaggccgcgccgcccatggtaaaccatgtgaggccgccgaagttgaaaacctgtccccgcataaggtgcaggatatgctcccgcaccacatggacccgtccgccattccattccttttccggccgagcgttcagcaagtcaaagttctcatggttcccatccacgaacagggtggtgaagggcttcttgttcagccagtccagccagtattggtcttttgggcttccgtcccacagtcctccaaaatcacccgcgatgaccacatagtcctcccggctcatttctttctgctgtgggaagtatttgctcccaaagcgttggaagccgccgtgggtatcgcctgtaatataaattgccattccatcgcacctcgatttacagggtcatttgctgttgccccggcagcggggaactgatctccgcatcggttgccgtgcggattccagggccgtttttggtttctgctgtcaccagcaggtcatcttgaacaagctgctccatcagttcgcccacgaagcggttggcaagattatgcttgccttctttatcacagagcctgtgtacagagaacttttgagcgacatttaaagcaaccgagcctgtgatatacaggtttttccgttttgtccggcaccgttccagaatttcatgtgtgatctcctcgcgcttggtctccaactgtgccagatattcctcatcggtaatatcccaatacctctcgtagcagtcgaagccatagcagcagaacgatttcgcatccttcagtagttcttggatggctgggatctcgtccatctctataataccactaaagttcatcggatgcaggtataactcctgccagcctttcgtaacggtatcagatgtgctgtccccaccgggatgtagaccccaacccgcactctggaacaggctgcggctttcttcatgaaatttggcggcgtcagtctcagccggccagccggaatcgaactgatagcggctgcgaatccggaagtaaacttttcggtactccactcttgtttcacctcgctttcctattccaagtgctttttcaaacaataccacaagtaaggcggcaacatctattcaccaataccaacagaataaatgttcataaattgacctattctaccgatatccttccgccagaccgacgctgaccccaagcgcccagtcaatctgtttcatctcggaggtgtccaatgctccaacgcgctctctgagcctggacttatcaatagtgcgaagttgctccaaaaggataacggaaccacagctcaatccattcgcttgcctattcaaacaaacatgtgtaggcagccgcggttttcccatcttgctggtgatgggggctgcgatcactgtggggctgtgacggttgcccacgttgttctgcagaatgagtaccggacggataccaccttgctcagacccgatgactggccgcaggtcagcatagtaaatgtcaccacggctgatttcctgtctgcaatatgttttcacagaatacacctcctcagcatattgggcttaatatcacaaaaatagggaccgcctccgcatctcccgcatctggttggaatggctactcatacggcatgttccggtcagtaaacgggttttggacagaagcgatccccatagcttctgatattaagacttcacatttgtgttgtcttctgctgcgctcgtattcgacactacttccccaagcgcaaaagcctgcgccactggcgctggctccgtagggcgaccatctgaaccgcggctggcttcaccgcgtcatgggactctcacccccggcaggatctctgtcggccgccctcattgcttgatccccatttcggtgggggctgtgactggacggaagtatcattatccctggcggagtcattgcgatacagcttgccacaggctgttttttggacggatggacccgcttggcaccttatttggccgtcgttgatagaggggaaatccggcaggctgtcataaccgaacaaaaatgtataggtgacttcgtttgcagcctgtaccagaacttctacaggtggttttcgcgcatcctccagcgtcgctttcccctgtccagcaggggccccgtcaggaaagtattcagacaatcggatattcggttttcaaggaacaagtgagaagcatttccttctcgcttgtataggggaagatgtcggcattttaataaccctacaatttcaattttctaaaagttttttcaaagacttgagaatacggactttccgcttatgcactgcaggctgtgaaacgccaatctctcttgcatagtcaagttcactttgtcccttaaaaaacaacccctgtaccaatgcctgatccgcagcaggcaacgctgagatcgcttggtacagggcctctttcttcatttgttcaaggatgatgtgttccggggtgttgatggcgtcaataaactcccggaaattttcataggcgccatcctgacttccgatcatcccactcgtctggatctcatggtcaaaaaagctctgatcattgtccttgatattccaccgggttctgcagtaagtgcgatagacctcctctgtcactatgacttcctcatattcctgagtgcaggtgttaaaaacaataagggtaaacttcccgttggattccatgtgcctttcctccaaatttcaagattttgatggcgaatcaaaatcttgaaatcaggggtacttggcgatataagcctcccagcccatgccggccctcccagtgccgggcagaaaaatagccggggacgcatttctgcatccccggccgatccccgccgccatattgcggcaggaatacagagggccgggacactttacagcgtcccggcccttgtcagctggtcctattcatttttgcgcatacctgccactgtactgagtatagcagaggcaaagtcggaagggagtagggatttcgtcggtttttcatcgggaatcagtcgggataaagtcggggcatctccaattcttcctgaagttccggcacagcataaccaaaaaggcagagggacaataagaagatcgcctcgcgctttcggtcatagaatacgcttcgctccatattcagctcatccagcagttccttttctgtgctgttgaaacggtggataaattgtttggtcaggatctcatagtaaagttcaccccggtcagggtatcgtttcaagcggagaagggcacggtcgatcacatccaccagcatccggttttccatcacacagcagacccgttcctcaaactcctgcagatccatatccggggcgaaactttgcagatagataagcccggtatcagcgtcctgagcgcccagctcccaggcgtactcatgcagttcctccacccgctcactgaggacccacaccacatcccggtagattttcaaaatcagctttacccggtgataggccagctggctgtcaaatccaagggtcgccatctgccttttacatttctgcaaagtggaactttcttttctcatgccattctcctcctcccatgttcgctaaactgcgaacaaaatgcatataacaaagcctgtgaacattggtgcggctgcgcccctctctcaggaggggggcttgccgtaccaaacttatatgagattgcgtgtttccaaccgaatacgcatggcctgcttggagacttggaagatctgagccatttccgcaaccaactgctcattgctcctgcctgcacgcaaacggtaaaaacttcttttgatttgcggcaggggcatgaggagagcagtagccaaagcatccgcctgccattcgaccagaccgtggctttcatccaaagatgtttttccttcataggcagccacatcgcctgtgccggagtacagcttctggtgcaggacccagtgccccaattcgtgagcacaggtgaaccgcagcctgccgaggagcctgtccacacaaagccgctcctccaccaggattgttccggccttgactgcaatcaaacggtagcgtttttcatcttggtcgtataaaatagccgctccttcatcaaaaatcgtttccccaaggatgctcccgtttttgcgtaggcaatgatattccagagttagatcaaacttggtctctatgatagtttcaatgggaactgcctggggaggcccgtccaacaaagcgggatcatactcttgcaggatcttccgtccaatggtttcaattgcgtccaatcgatactttggtacagacaagaaaatccccccttagttctggcggttctgtagcatttccataaatgccttccattcctcatcggtagcatctacttcctttgccactctcaatgctgcgcggacgatgtcatgctggcggatatagtcaggcagatcggccggaaccgtctgcctggaatctgcggccagatccagcagcatttcatgctcctgcttatccaattccagaaaagaagagatccgctctacaaatgctccctctggcgctggccggcgaccctgctcaatatcacacaggtacccattggagataccgaggtgtttcgcggtatcccggagatttaatttggcctctttgcgccgtgtgctgatgaaagctccaaaggtcactggtctccctccttcatagagtttcgctggtttgcgaacatcttgtttatattataactggcacatctgttcgacacaagggcaaaaaagaaagcagaggccaggtgttaaaattccataacacctggtccctgttttagagaaacctgtgggcgatccgcttcatttcttccacacactcatgaggtgctatgatctgaatcccgcccataaatttgaatacccatccgtaaaaggtgccgcttgggtcgacttcaatgtttgccgtaaagtgttcctcgtcatatgtgcgggttggtacagcttctccataatggtctatgatggttttcatcagcttgttctcacagagcagttcaacagaaactgtgcggtcagcagcaaacatatcaacgatcttgttggtgtagcccgccacatcaaagtcttcatcgggggtaaagccggagggaagtatcttgatccccgacagacggtctactcgaaagtgggccatccgctggtgtttgtgagaaaagccaatcaggtaatagtggtcattcttccattccaaagcgtaagggtccagttgatagagataaccgccatgtttgagaactcgttttttctcgggcgtatattcataatactggaactgtatctgccgcttttccaagattgccgtttggatggcatcaatgatgtaatagacttgctcattgtccggtttcacccggctggacaggctggcgagctgccgaagctgctctgcctgatgtgtgctggtcagacggcataatttctgtaccagttcctcggatttcctggcagaaatgatcttcgaggatgctactgcgtctgtcagcattttcagttctggatactcaaacaggcggcttcccataaaatattggttttgggtactcttgaccaccacaatatcaattcctgcatcgatcagcgcattggtatccgcgtaaacagtctgccgcactgcctgaattcctttttcattcagatgggcaatgatgtcagatactgtggcgggatggttttcatcagtccgctcatagagaaactggagcaattccagtatccgcatatttgttgaattctgcatacttcacctcctcgattcttaaaatggtctattttgtatggtgtccagtcccaaagaccaggaacagggcaaccacacagagaagcaggcccatccaattccggtctatgatcagcttgattaccgccgcaagcagcagaccgcccaccaggagcacaacgccgttcattcagcgtcctcccgaggcatatttccccatgtggatgtccagcacttctctgggcggctggatcagcgcgtcctcatactggcacttccactgaatctcccggctcatctggccatccgccacgccgtctatggtttccccatcctgaatggggttatcatgctccaatatgtacgatgccacattgtaggcgtggtttaccacccagttggggtccatgttgtggaagtggtactggaggtcgggcaggaacagggtgctcatgcccaccgtgtcgatgagcatatcctcggtgccctcaatgttgaagaagcggacattgaccccgaagcgaatgaaacggtccgacccctcaatctggtgagaacgcacatcctccgccagaaacagcttgccgcagttctggaaatagaatgcctcacaggtggggtacagctccgccagagcctccagaaagtcggcatccaggttggcacgctccagcgccggaagcgccgcagccagcatatcggtggccaccacctgatatttgcactcccggaagatccgctcccggtcctcctggcagtcccacatctggctcatgaggaaggcgtcgaagcctttgcccttgaacctgtcgcatttcatcaccatcagctgtaccgggcatttgccgtccttgaattccgcgatatgctcctgtgcggcaaagccggccatttgcttatcataacagaagcactctgttgatccgatgtgtttctctatcacagcggtcatggtttctttgtccggcatgtccaccggttctttaaacaaaatctgaatgagataggggcctccgggctggggaccctttttatcatccaggttttgctggaaaagttgattgctcatttggtttcctccttcttctccgggaacagcttccaccggaactccaactctttctggacaaactctttcggcaggccccggggattggcaatgagataccatacccgaaaggtgcgtttcttcggatctgtttcctgctggtagagctgatagcccgcctcatcctcctgagtccactgtcctgtctgccgcttggcctgcacaaagggttccaccacctggtccagttcctctttggtgaggcttgaggcccaggcatgatccacatcattggcgtgggagaggtggaacaacatcgaacccatccagttctttgccttgtgctccggcgttccgagcaattccgcctgacggcggtactcctccagctgttccgctgttccgtaccgttccaccatctgttcccgcacatggatgcaccagctgtaatcccccggctggataaagggggcacagaccggctggagcgcctctgctgggtccacctcaaagcggtcgataaagtcgaggtagtgagctttgatcaggggcagaaaggtgtccagcaacctggtgttcagccgcaggtcctctgtcagcatccgaaagaatgaaccgcctgttgtcggttctattttgaaagagtagagccgatcatctccctgcttaatgatacagctgaagcccacctccacatttccatagccgatttcgtagtctatgtagttgtagcggctccggtcaaaccagacctgataggtcaggccgtttttcattttctttttgaagtcgccttttttcagccgcttccagcccttttcctccagccccaggccgttccataggtagtccagaaactcctgaaatatatctgccgggcgtttttgctccacggtctccacctcctgacgaatcctccttaataatcaagcaggatgggcacctgctgttcctcggcaaaccgcatggcccgccagaacatggagaaggcgaacttggcaagagattgggtgtcatactgggtgtgttccgggatgtctgccttgctatactgtccatctgagtctacggttccgtctaccgggtatccctccgtgtctgcccagccaaggatggtatcctcatcggcctgccatgccagctggttcagcctttccagctccttccgcagtccgcccaaggtggcgatagcgacggtgtcatcggtgggcagagggccttggaacagaaagctgtcggtgaggggaagccaccaagtcacgccccgaaacagggaccacacccgctcctcgtccgatgcaaggcgggcaatcaagggatgctccccgaagatccagtccttctccacggtgggaggcaccggttcctcgtatgtacgacaggcggccaccagcagcatagcgccgaaggcatcccaatccggcttgtccgtgtaatagggcttctcattattctccggccagggggcgtaggggggctggtccggctgagaaatggcggccagaatctgatcccgccagttctccaccgccgcctgaacatcggtcggggacaattcctcgtcgtcggcgggttccccatccggggtgatgcggttgaaggaatatccgttttcctccgcccactgctgaacaacggttttccagttgtgagaatagtaccgggtcagcgtcccggcgtagatgtcaagtcccatagtgtttgcctccttttctgcttggtcaaagccgttccagggtacagtcgtgcccggaatggtctgtatccaaaatgatttccacaatggtgtccatcgtctcttttccgagattacggacgcttttttcataggccagccactggatgtggatgggttgtccatactcatgccgcccaaaaccgccccgaagaatatcgttgaaagcgttcaggttccgaccgatcttccaatccaagccacagatgaacacctgctccacctcgtcataaaaaccggccatgttagaaaagcggcgaccgtcaatggtgaacatctctctcatgtccatataaacggctcctttaagtcatatttctccatgatcttattttccaaggcttcataggcatccatatcctctggttgcgctggaatacccttttgccaataaccgttcccatagtagaaaaacatagcccagtaataaggcaggtcatggctgaacatcgccactcccatggcatcggccactggctctgccagcggtgagcgatccactatctgggaggcttcctcataggagatccccaccagctccaccagcaggtgcttcaccagttcacagaagctgtgctggttgaatatgacctgaccatcctcatctttgaacacgatgccatctctcaccataatattctgctccgtttcttactcctcgtccccggccttgaagttgtagatggggcggatgacctttaccacatccgccgtggggccgatgttgtccagaatatcctgcatccccttgtaggccatggggcactcatccaaggtggccttgctcaccgaggtggtgtagacctctgccatctgctttttgaattcagacaccgtgaaggactgtttggcgtccgcccggctcatcaggcggccggcgccgtggggagcagagcagttccaatcctcgttacccttgcccacgcagagcaggctcccgtcccgcatattgatggggatgagcagtcgctcgccctctttggcggacacagctcctttccgcaggatcatggcgtcggtatcgatatagttgtggatggtggtgaactgctcctccacatggagcttcatgcctttgacgatctcgtccatcatggcctgccggttgagcatggcgaagtgctggacgatcttcatgtcgtggatatactgctcaaacaactctccggacacataggccagggccttggggatgttggtttgcttgaggtttttcagtttcttcagttctttctggatctccttctcccggccctccgctttcattcgggcaatcagcgcctcgatggaggcatcgtcagtgcggttgagcaccttatagcccgcctcctggtaatagctggccacctccacacccaagtgacggctgccggagtgaaccacgatgtagagatttccctcgtcgtccttgtccacctcaatgaagtggttcccaccacccagcgtaccgatgcttttttccgcccggaggagatccacatggcgggcacagcacaactcactcaggtcgatctcattgaggtagcggtgggccttatcccggatggagaagccggaggggatcttttcataaatcagcttgtccagcttttgaagctccagccgcccctcccggatgcgggtggtctccatgccgcacccgatgtccacacccaccagattgggcaccaccttgtcggtgatggtcatggtggtgccgatagtacagcccgccccggcgtgaatgtcgggcatgagccggatgcggctacccgccgtaaattcctgattgcacagctcctgaacctgtgcgatggaggcgctgtccaccacatcggtgaagatcttggcctcattgtattttcctttgatttcgatcataatttcctcgcaatattctatggggcatggccccgtcaagtcatctcatacagcagggcagcgtcgccctgcaccagttccagatgggagcgcagcgtttcaagcccgctttgcaccgcctcggtgggcagatcccagtccggggcaatttcagcggccagctccgggaggtcctgctcccgcagagctgccagcagttgagacgccagctctccctccagcagagcgcagtccagggtgtcctccgtctggggagcaggaaaacggacatccagatccagttcgctctcacaccagtcccagatggccatatagaccgcgccggagcagtcgccgtttgacagttcctgccgccggccgtctttgagaaggtaaaaggatgcgatctgtgacatagttgttcctcctgaatgttattctttttccatcagcccttctgcctgcatccggatcacatagaaggcccgcacccagtccagttcctgctccatggatttctccaaagccagcaggtggcgctttcccagcctgcggtccaggagggcaaagatgcggacaagaggattctggctgacaaggcttttctcaatgctctggttgtcaaagatcccaaacgcctcatagaacaccttttggtcaaaggtgccctgctccagcgcaaaggcatgagcctggtcgatggcttctttcgcggagtcgcaatctttcagcgttgtggaccgcaggtgatgaaatttcgtccacacattctcaaaatagatgtagtagttgctccgcagtacttccacaccgtccatacgaatggctgcccggccctcatggtcggcgcttttgctgtaactggtggcaaaatactgaatgtgaccccggagcgccgggcacaggtaatcattctccaatttgttccggattccactccaagtggatacgcttgccatgttaccacctctcagtcacgatagatacccacgaccaggatatagtcatcatctccatgaaaatcctgacacttgttatagaagtctctcaaagttctaaattcggccaacgctgcatcccgattttccactccgttctgttggagatacttgtccaggaaagcatcttcatccacctcattgagggcagaaacgatgtcatccagatcctccaagagagtgtaggccacctgaccatcatcaacgaaatcaacacctacgattgcttggctgagcggttcatgagagatcggttctgtcccagggcatcccaccagcgccatgtggagctcattccacaggcggattttttcggtgtagagaaattcatgctgatttgccgctgttttcaaagcatcaaccgtattctcgccactgaaaacagcattcatgagttcatcttcagcaggggcgcttccataaaaatagtgggcaatgttttcagtgttcattgagatacctcgccagtttcttctccagcagttctgccatatcattgcagaggcgctttaccttgtcctgctcatgggcgtagtaccagatggtttcctctccggggcggagcaggagctggtcgccgtccgcttctttccagaactcgcccagcacacaataccgctcgccatgaatggtcagattaaatgttccagagagttcaacgattacgcctgtggatacattgatgcctgcggtcagcaggaaaaactcccgcacctgggacgggagcgtgaagtccagcacgctttcttgattcccgatctgctcctccgtggcggcgggtttgatctcgtcagaggggtccagcacctttgccaacgccttggagaacttggggtatcggccaaataactccgggttattggccttgaattccttttgcttttccctctgcacccgctcctgctccttacagaaagcgtccagctccgccagataccgctcctggtagagattgctggcttcaaatgctgtgccgctcttttccagaatggcgatggctctcttttggctgccaaacaccgggacccactgaaaaccgtgtcggcagggcttcagtttcagaaattcaccccgactcagcagggcttccaactccgtctcatgttcgtcccaccagttccgccaactttctggtgtttcccgcccctcgaccaagtccaggagtttttctgtcaatgattctttgtccataggtgtccacgctctttctccgccatcacttccacattactcggtagcacaaagctcattcatttttggaatcagtattttatccatccactggcaaacaatctcaaaggtattgttaatcttttcttcatttcctatatcaagatatatttcattgtctctcaaactgtaaaacagtggttgtgtgttgatgtctggtttggcataaccataagggtcgtatggacgggtgttgattatatagcaaacctctatgcttatgctatcctttgtgttcccgccgaatgaggaaaacgcaatcatataggtgaaatttttactgtgcctcgtaagtgttttgtcggattttttatacttgaagcctaaatgcccgtacttcccttgcaacttggttccaagcatttgcattgcttcgttaaagttcattgtgccccctccattttctcatcgtaaaaataaatatagttcatttctccgtttcagagggcgcaggaatagatgctcatggccccgtaatcggtgtgcaggaccagcccgctttgggtaaaggcaaaattcacctgccgcaccacaaaggggtcgtcaatagaggccagcagttggccgctgccggtatcccacagctctatgggggagctgccacgatcctgctgaacggccatcagactgccccttgtccgcaccatacaggtgtctgaaaaatttagcccctgccggaccgaaaacgggaaaggattggcaatctcctctccggtctgggtcagatagaacctgccgcccaccgagaagcactggtcatccggagagaagaagggatgccagcccgcattggggatcacaactttttgggcggacttcagatcgaccagcacatactcaccctcggtgacacggtagaccgctttgctctgccggggagagagcatcccgaagcagtaataggcaaaattcggatcttttgacttcttacattttaccgtttcccgccacactttcgtgttgctgccaaaggcaaagacgacgatctcctcgcccgtgtaccacagggccaggtcgccactgacatccagcatggtcttcatgctgtttttcttgttggcaaagggcgtgacctcatgggtgcggagcgagaactgctggagaagatagctgttgttcagaagaagggtgtcattggagcagaggacctgctcataggtcatccgcttggcacccagagagaccgtttcaaggctctccccgctgccatcgaagtgatagagggtctcgtcctcaaaatctccgaccaccctcgtcaggaagaagtcatcccttgcgggagaggcggccaggggcatgaagccgttactgtccttaccgacaaaccgatggcaccgcgcctgcccaacagcggcatcccgattctgatagacaaatcctttccgcatctggcccatcatggcgctggcagccttgctcctgacctggaaagcggagtcgcacaggatctccttgaccttcccgccattcaagcaggttcggatggtatggccgtcaatttcaatccgccactgcttatttgtagtggggttgaggaaggttttttcaatcatggctttgactcctccctttgaatcaggatggtttttccctcggcgttgatgtcataaaggtcatccaaatggatatggaagccatccacacgagcggtttccgccatccccagagcggctttcgccaacaggagcagccccgcccggtttcccgttaactccaattcatttccatcggcatgggtggtaaaggagaggtaggcttccggttccactgggaggataggcagtagttcgtcattcagttgaatggtcagtgttctggttttcatcacttaccgaaatacctcccatcaatcccaccagaaataccagacggtggactgccacaggacatctgccaaggagccaatgcttccatcctcattctgatccagatctgggcagaagccatattgctccacagccacctccatagctctttccttggagatcggagttggaagttcaaactccaattcatcgtggctcatggcggcagggatggcaccatgctgctggaaccagtatttggccgcagccatcagctccggtgtgtcggggcagtcattccagtttccgaagggcaggtaggcgaagatctcccaaggattcttcaccgggatcttggccagaatgagcggataggtcatctcagtatcatcatcccagtagctggagaagcggtcattaggttctccgccctccatctcgcccaagacttcctcatcccagtccatatcgtcatcttcggcttcttccttgcgctggccggtcaattcctccaaaaccgtctttccgtccttgacgggggtagagagcatcttcttccggtactccgttacagctttgaggtcaaattcgtaaatgtctacatcattcttcgggtcggcgttcattaccagacattccaacagcgtttcatcatccgcctggataagcacgggaacaaagccctcccgtacccccagccgctgggcgtagctgtatgccgacatgatggggtcatcatctgccatggatgggaaataggtacactcgcagtccaaatactccatgatggcctgagccacctcggaaggctccagtgtgtcctcgtcgaagtcctgtccctgccagttagcaaagcgttcttcgatcacctctgccatagcctgatagtagtcctcgtcaaaggggatgaacaggtaggcttcatcttggaactcatcggagtgataccgctctgggccgaagaagcagagggcgttgtcgtcaacatcggcaggatagtagggactgtcgccctctccatagtaatagcccgcaaaggcacggccttgatgattgaacagcacagagaacagacagccgtccagctcatcccggataaactcccgcagatccacgctggcagaatcagccttgaccttttctacgacctctccgtactccgcaaggaattcttcacccatcaggtcgtgctccatgcaccagcgcaggtagatggccatgtggttataagcattgatggggtcaataggcagttccttttcctcgatgctctcgatgtgataggaagcatcgtccatctcaccgtcaaaatcatcattggaaagggtgccacgagtgatagcatcctggcgggtggggtttactacaaaactgatccccctcattttgttcagcagagcgtctgtatcatgttccagtttatagtccaactcgtcctcataaagcggaatgacctgatagaagttgacctcctcgccgcccggcagggtgcagacctcgctgccatcctccgtatcctggggaccgatcagggtagcagtacacagtttggtgttgtctgcaaatggttcccggttctccactgtatgaccatgtcccaaccaactgtcacagttgatgggcagacgggccaaggatttcagcaggcggatgggccagtaccacttttcgtctttcatggactcctgatccagcttccagtccgcaggcagcgcgatagccagctccgcccgctccagcttatattccaccagctcctccggcacattcatccggtgagcgcccatacccatggtgaccagggtgcaatagtcccgctcctcagtgggcggcaccatgcagatgtccacatggatgtctggagaaaccagctcgtggaacacattctcgaccttgccgaaatactgctggatgtgtccctcgacggcctccatctcctcctcggtgtagacctcgggaacaccggcttcttcatcctcgggcatttcgccgtccgggtcatcgccgtcatcgtcagggtcaccgtccgatgactcccaggagattttcagcgtcatctgctcctccggcagaccgacgccagggctgcgggtgatggtgtgcttatcatctgccgcaaaaccgatagtttctccatcgtggagttccacatcgttctccagcacataggacacaaggctggccaaaaagtcccgcaggtcgctcggcttggcatcggtgcccagcacctccatctcgtctttgccaaacacatccatgccgtaggtgtagccattcatgccattctcgtttctccacagaccgaaccagatccagttgaagatgggtagttcgccgtcctgcatcatgtcggcaaagccctcatagaaccggggttcaaacaccacgccgctggtgtagatgccggtggcatattcctgacggcagcaggcggcgaccaccttggtgtagagcttgcccttttccagcaggttttcctccttgcccagcaccgccaccatgatgtgggcacagtgctccttggcaaccttgacggcgtcctcccacatatagttgttctcggcattcagttccgcttcgccgttggggatgggataggtcgccaggctgacggcggcgaccatgtcgcccacttcgaacaccagcgcgtcatcgtccttctcctcgctggcatcgtattcatccacggcgatatcccacttttccttcatgtcccggatgaactgctctttatcccattctcccttggacaggaggacaaatccggtgaaaacgcctgtgtggtcactctcatcctcggcctctgcctcggcccgctttgcgatctctttctggcactcttgaatcaccgccggggcatccttgtcttcggggtccagttctgcccaccgctgggcgtaggggatagcctgttcctcctgcccatagagatactgatagccgtaggccatccgcatattccactccgccttgtcctggccttcctcccggacggactccagtacctcaatggcgcggcgcagggccttgtctcccttatagttaggagtaccctcgtcgtggtccccgatgatggcgtaattctccagcgcccgcgccatggcgtaggcaatgcgatagttccgccagtcctccgggatggcgttgagggcctggatgcagcgggtgtactcgtcctcgtcgttccactgctccagctgctggaagtattcttcttcgttctgcggggtgtaagggatataatccatgcccgccagcgtctcgtccagctcgggggcctgatcctcatcgtccggttcctcctcggacggtgtttttaggttcactgtgcccgcctcccggcggaaggtgtggaaactggcccaggggatatcgctgtcctcaaagaaatttttggccatctggagcgccgtctggatgtcccaggcgatgaaatccacatagccgcagtagaggccggtggctcctccagtgagagtgagtacctccggaccgtcgccggtggtgaacaattcctccagcttatcccggaagtcgaagatcttctgggttccttctttctcccgcagggtatccagagggtagcagaagaagcccgccaccgcgccgtcagcatggagatcgtccatgaagtcattgtcggcattcaggtagccgttgatgagcggcacacagcaggtggaaccggccattacatccagccgccagtcagcgtcggggtcttcattgggtttcatttcgtagccaagatagctctccagataggcttctggatcggtagagagttccagaccccgctccttcagagcgtcgggaagctgggacataagaatggacggctccgccctgggttcctccagcacatcaaagctgtctatgtatctcatgtggggaatctcgcccagcacttggtcggtgagggtggtgagcatccaccagacccggccttccgcctcccggagcatgggcagcagcttttcacagtaggcggagagggcgaagctgttttcgccctgctcctccagccagatctgcacatcatccccggagatgtcccatccatcctcggtacgcagaccgatgttctggaggggctgacggcccacaaggatgttccagtgctccagcacctccttgggggcgtgtttctggaagtagaccagctcaaacagcttgaccttatcaccctccggggtgaggatcagctcgtacttctcgccgttgaagcccatctcgaaggagatttcatcaaaggccagattcagggtttcctccatttgggccacgagttctgcaccgcgggtgtgatccttgtcgtcatccatcatctggcgcaattctgcttccatctcggcaaaggtttcccaccagttctctgtccgatcccggaagcactcccagaactgcggcagagaaataccctgcttgcaccggtcgataaactctttggtgtcatcgtcaccagggcggacttccaatgccttttcaaaatatcgcagagcccggccctcctgatccagataaaagtaggagtaacccatgcggaagttccagtaataatcgtcctcgaagtattcctcatggggctttagcagagcgagggcctttttgagcatttctttgcaagttggcttatgtgggtctgccagattgttataggcacgggctaactcactgtccatctcaggggtacgctcctcggcggggatggcctccagcgcatcaataattttatgttgtttgctctcctcatgccacttctggcactgcttcaaaatgtccatatcagggtcctcctcgtcctcatccggtttccagtctttgatctgctggaacacaccgttctcatcccgctcaaaggcgcagggggcgggggtgttcagcagagaaatgatgtcgggatcgtcgttgcaaattgtgttcagcttgtaaatcccggcattgttggggtcgtccatgtacgcctcgctctcgtcaccggcggtaaagcgccagccgctgtcccagccgccgtccggattctcccggtagcagtagccaaccttgtagccctccatcgtaatgcggttggtggcgatacagccatcggcgccctcccagtcggggagcagattcttcatgtcctctgcctttacatagtagtcccggttgcggccagcggcctcgtacagctccttccgcagcgcctccacatcccgagccatctcctggatctcctcgttatccatcatctcgctgaggtcgtattccagcggggcatggacaaagtccgccagggccttgttcatggcgtcatgctcctctggcgtagcagtgatgcggatacggcgggcgggggtgttgtactcgtccagatcctgaaggtttacactgccactgacgctgcactccagcaggatggcggccaggtcggtgaccacatcaatggcgaagtgaaagtccatctccacaccatcggaatgtgtaaactccaggtactccacggtttggcgaaagtcccagttctgcttgtccagaccgatcttggagaaaatctcgctgagggggatctcctcctttttctgatcctctaaaaatgccacaaggttcagactgtcatcggaaccgccaataaagttgccccagtattttttgatatacatttgtcgtgcctcctgttctgaatccagtcgatcaatgagctgattcaagtgttccaaccacgcaggagcgatctcaccgctatcctcgttcttccaaagatccataatctcacggatgccgtcctcgtccggcacctcgtttttgatgtcggtgagctgccgcagcaggaaagcaagtgcttctttggatgctgtgaaaccggtgactttatcccatatagcttcttcatgatcgtagtccagcttgccgttatccttccattggaaatacagctccgccagagccatcgcagtattgtcaaagagaaagtcgatttgtgagaagtcagatcccagcatgacttcctctttcatcagttcaatcatctcgcccagatccattaccggatgctccggtacatattcatttttgaggatgtccagtacatccagcccttcgtcacgctctaatgcttttataccccatgctcccatgtcggcacctctctttctttatttcgtatcaagcttctattgtcaatcatggttctccacccggataatgggccggtagaagtcataatctccgtttagttccttgtcctcctgcacttccggcttacagtggggcgaacagggtaggaaaccgagaaatgggcccagcccgccgcagatattgcacccgccgtcaccgccgcaggtggtaagtctatcagcctgcaccacttcccgcatatagggatcgtaggcgatggacaggccgaagaagttgggttcctccatatcatagggccggttctcatcctcatccatgtcctcaaaccagcgtagacgcatggagtagtctaacccatctccccatgggaacagggtccgacatccgccgccgcacaggtaggcccactcgtccgctgtgggcagcgaaagcccctgcttttccagcccggcaagaagcgcatcgtagtctgtgcagtgatagatccaggtatgaaatccatcttctgtccgttctatgcgggccgactgatgcaaggtaagactgctgctgtcactccaagcaaaatcacggaattccttcagccagtcagggtgggcagtcagcctgggatcgtccatcttgaccggctcccagcacagttcctccagctcccggcccaccagcatggggccaatgaccgcctgccgaacgggagccatgctttcccggatcatctcttccgggttctgcggttccatctcccactcctggaacagatagtccaattcctcccggctctcctgattcagtccctcggcaaactgctcccagcccagggtgacggtatcgccggggacaaagacgaactcccgaccatctttcttgaagatgccggtggtgcagctctggccccagtggtcaaaggtatgtagaccgagaaaggtcatagtataacgagcagccaggctttccatcagcgcctgcttctcggtggtatccatttgattgaattggggacgggacagtttttcgttcatggaaagtcctccttcgattcgttttgcgtgttccagcagatagctctgaccatcctgcttggcccattccaagtattgtggaagctggtcggaatggatggcatccagtgaaatcagaacggcgatccgctggtattcctgaagttcaggagagtaacagttgcgctcccaaaacagcggagcgaactgttccacacagtcaggacgcagagcaggcatcgccaaaagcgcccgccggctcacatattcattggggtcctttgcgaaatccagaattatatccctgactttctgactacatgagcattccggcagataggcggcaaactgccacttggcctcattctcattggaagctgcggccctgcggcagaggcactcaaaccattgtggatgggaagtggtctcctgtataaatccctccgcttcgttggccctggcaattaaatagaccatctcatccagtaggacgctgtctgccgtttctgcatccatttgggtcaacatatggcaaaaggcactgtaagtatcattccagtatggataatcgacttcccattcaccgccgagttcctcgctggttttgccgggataagtggcttcctgccattgatggaatttgattgcctgcttcagcaggcgttcacgaatgccctttgccatgtgctcacctcacgattctccgcacagttttccgatctccaatgcctgctccacaaggctcaggagcagactggaaaagctatttgcgatctcctccaaattggaatagtcgcagttataaccctggactctgccgctctccaagtcaaggaatacgatacttccatcacccaaaccgccaataggaaatacaggaccatgctcacattcgctcatgtagtccacaaaggcatcctgaaatgtggggtaggcttcctccaattcctttagtgtgaagatccacggctcagccaaatagcagccgccgaagttcaaaagcagccagcggtactctgccggaatgggagcatatctgctttcaaatcgtttcacagcatcctctggttccgggaagataccctttgtgaaggggcttgctttataagcagtttgaattttactgcggtatttttccaaattcatgtcatgcattgtgtttccctcacagagcatccagattttcctgtagatcgccctgcatcaagtgttgggcaatggcccggttcaattccttatgggggtgataagcggcctgctctacatcgtgcaggcactcctccatcagtgcctccggagaaatgccttcctgttttccataaaggtgaccgaaggcatagcacactgatttgagaaagccgaaaatatagtcgtgatttccacgcatactgggtaggtcattgaacgagcccatacctccgtatgcccgaaggtggtgggaaacctcccgccgctgggtccagtcctcaatatcccgctccagccagccgatccagtttttgaattccgggtggtctgtctgtaaaatcgaccgcagacagatcagagcctccgtataaatatcggtctgtttcataggccatcgccccccaaaatacctccatagagaacaccgtttttcccgaggaacagcatctggctgcgaagtaggctgcactgctccacagcgaccttgtttccgtcacaggtgggaatagcctcctgtttttgcccaagacgatcaccatgagcagtaaggaagtagaatttgtcccgttgctggtatccgccttgaaacaggaaggtattgccggacggggcaacagaaaaagctccgcttccttcgattggcagttcaaacacaaagtcctctttgaagttcgtccgcaccagccggaattcatcgtaataataaaaccacaggttttcttcttcgtccaggctgatggcgtagcagtcatagatggaatacttctcattcttccagagaggagttccatccgatgtccatgcaatcaggccgcaatcacccagaggttcatcccaaccgtaattaccaaatacaccttcatcaaagtagctggtaatgatggtgccatctttttttaccacgcagtcttgaatgccatcccccaggcagaaacgggacagcacagctccgtcccggctgacgatccaggcgttctggtcggggccgttttcccgataggcgcatcttgctcccagcaggaggaagtgttcacctgcaggccgcaaataatggaactggaacttcaagagaccaagaggaaacagcgtcgtttccagcacccgctgttccgcccaatccaactggatttccaccgcggtataggtggaaggaatgctgagccagtccttaccctgtgtttcggagggctgttccatgagaagatagacttttccatcccttgccgtgaaaaagtctgttacttctgtgccctccagatggttttcccggcgcagctggtccaggtcaatgatggagaacaacggcagattttttgcttttaaggatttgttcattgggactcctcctggttactttaacgctccatcataggtgtgagtttcccagatggactcaaattctgctttctctattacacaggcgtggaactcctcaccccagacatgggcgttcaactcatccacggtggggatcggtgtaatctcgatggcgccgtcgtaaaggtcagggatgttgcgggtgcggccatctgcaaagatgtcgatggagcggaggaccagccactcattttcggtatccacttcatagaggatgaccgctggctctccatccggtgcgccctcccaaaagagtttgatgtactcgatcattccatttccctcatttgaaccaatgccaccccgtcatggtgccggttacctcatctatctgtaccgcaatatcataattgccgcgacagcccagcaaagctgtaggatggtcgttttccagaatcaaatcataaaactcaaccgctatgtcttggaattccttcggaatctccagtgcagagaagaaatccactgattgagcattttggaaaaattcaatggccgttttactgcattttactataatccctgtttgagtggtcaactctttcatgctttcgcagcctcgctcatgttcagatacatccccatcgttttttcattgtcacaggccgcccggatcattttggacagtagcatcaaatcgtcgatgtattgggagtacacgcagaacacatcctcgtcggaatcaaagtgaaacagatccacgccgctgttattttcctcgaactcctggatcacgccccggacaagccgctcccaatccgcgctgctgcctgtcagtcccagccgtcggaatttctctgtccggaatccgtcgctgatctttagcagaagggagatcgcataggggtggtggggaatgagaaagaatggcgcgatctgctctggttttacccagattttgaagggcgggcgcggatcaggtatccagggcaagatttcccattcgtcatcccgacgatttccgtattggcaaaagtctttcatggctttgcctcctgtttgagtctctttctgcatttctcaatgtgggcctgtttggtggctatgatctccagcaccttctctggctttatccgcagcagaagcgcaatcttctcaacaggcatcccgtccgctgccagcatacagagaatttccttctgtgcggaggcttttccagcagcaaaaccagtatcatagtcgtgagacagcagggcaaagaattgctccggtgtcagagtggaaatcagttcctgctccccgtgatagatcctgctgcggagcatttccagttcataaagtttcatttctgccatgctgtactccaatcgtcaaatcggtctatgtaatcctccccatagcccatgcgccagccaatggagtatcgctcgatctcccggtgggccagccaaggggcggcatgattttcttatcttgtagtgccatattgttttcctcatttttctttcaggcttcgcatccgtttcatgatctgctcctgttttttcgcggttttacgctacctgctcaaaaatcccgcagctgttcaaactgctccagcagggcatctttctggagtgcatcgcctggcagggcatccaggatcccccgcagagccatgtaaatttcatcccgttcctcggtttcgataaagcccatcttgttgaaggtctgagtgtaggctgccaccgcctcaagtgcctgggcttgggcgtcctcgcccggctcagcggccagcttcatcagctgggaacgggtcttgcggtattgattggctgcctttttcgcagcggcggcagggatatgctccgcaccgtcccagccccggaagggattgtccaggttttgcgccagccactccggtttccgggccttagtgatccgcagatccattcccggcttgcttttccagagctgctttgccgcttttgccgccgtctccggcaggctggtcatccagaaccagcgaagctccggcacctgctccggggtggggatgtcagctgcgccgaagccgaacaggtcgaaggtggagaggttcgtcagttcccggaaccctcccacggcggagaagttccccaggtttcccggcgcgccccagagccgcagttccttcaggtggggatggacagcagccagcccggtcagatcaaagtccttcagctcgatgccatgcagcccccgtaagttcggcagttccgtgtgcgggcagtattccccgataaattggagggtcaagccgctgccatcttcgggggcatggatggtacaggcgtccggccccttgttctgaaacaggagcagctccgttccctcacacagccacagctcctccagcccggtcatgtccagcatcagctttctgatgctggtgcctcgcagatcaagtgtcctctgaccgtggttcagcagggtcagctcactgataaagggattccccctcagaaactccagcagatccgggtgccaccgctggcagatgagttcggagaggcaaggcagcgcctttagttccagcgccgaattgaatggcgcgtactgatccatcacccgatgactgctgaccttcaccgggataccgccgatctccgtttgctcatcgctctccatggcctccttgaaggcccgccgccgctcctccgggatggcctgccaccggatctggagatacacatcatggccgtcactccagcctccgtaggagcagcagggctggtcggtgaagggcggcagagtccccaccagcgtgtactggggcgggacctccaccggcacccgcagcagatgaaggtcacgggaccagtacatgaagtccttgtagagcgggcggagctggggcagttcctccgccgtcagaggggcgtcacccacccagtccagggagaggaccaccgcccagggctgcttgctcaccgagtccggcggcgcaatataggccacctggcaggcggtgtagcgtttcagatattggttgtagactgtatagacctctccggcggtggctttcatggcaccacgctcctctcatcagttcttttccagatagaatccccatatgcagttggagaattctccagcggcaaagcggtggatctgcccgtcaatctccacctgccagacctcgaaggtatggtcttggtgatagatcgggtctttgacttttactcgcttgccggtggtttgccagtcgtagtcaaagatgttcacaccgaacaatttgcattgaccgtccggaccaaaggttttatattccaaagccatgtgatgcctcacaattccgagcgctgccagccgttcagccgctcctgcaccgcgtcgatcatccagccctcgcccacacgcttcatgaggaagcggcggtcaaagccggtatttttctctctggtgtagatgcagagcttgttcttggtgatctgctccgcgtcaaggaattcttcccctttgtaggtaccctgggcactgtatgagaggcccagaggccggtagcccgggcggggcttttcgctcacatacttttcccagattgccagcaggcggggcacagcctgggcatcttcaaatccagcctgctccatatactgctcccactccgtcatctcagcaaagaaagcggacagcaccctgcggcattcttccaccgcctgcttatccagctggacgggatttttggccttttcccgctggagctgggagaagtgttccatctgctccttggtgaattgcatatgggccaccggctcgatgcggttgttgccagcgatggccagcaggccctcataggtaacggcggtatggtcgatctggatgtgggagagcttggggatggaggccgcctggagcagaccggcatcatccagcccggtgcggttgagggtgagaaggtccagcttgcagccttgcaaggcgggcaggccgctgccgtggatggcggcgttgccgtccaacaaaagatagcgcagtttgggcatagcggagaaaacagggaaacaggcgtcggtgagggcgccgtcctccacgccgaaattgaccatgcttttgtgaccagcaaagggggcaagcagttcatcggtcacaggacagccttttacatgaaagccaaccagggtgtacctggccagccgctccatgatctctgcggtcagctccggggtctcaaatttcttttccctatccagggtcaggacgccgttttcccagtccgccgtccgcgcccgttttggccattccattactgttttcctccttacgcctgctccttgtagctggcttcaatgtcaatgaagcgcacatacacggcgcagacttcgccctttgcatcatagccgaagtagacgggatagtaaccgtcaccccagccagaggagaagatgggcaggttgcagtccgtgtccggcacggtccagttgagccagtcgccgcagtccccctgatatttggggtgggcttgggcgttttcctccagtaagtcgcagaacaggtcgttgtaggggtcgatgtccgggtcctcctccagccgcttggcccagtatgttttgaaagccgcctgggtctggatgtctgcaatacaccccattccggcatctacgccgaaaccgaagtagtcatcatctcccagtgccgcgtccagattctcgttgcccaccatgcccagttcatagcggacaggcttttcccggctgacctccaccttgacgcaggcgtagcggtcgccgtatttttcactgggcaccacgcagatctttaccgggtaagtcccggcggggatcgtttgaaggaacggcagagtgtcctccagctccaccagcggatcacaggcgaagatttgcccggtggggaaatggacggtgccgatgtccagcacatccaccgccatattcccaatcactttttctgtaaaatgggcctccaagtcaactttgcaggtcagtttatccttgatggattcgtatttgttcagccattcggtcgtaggcatatcagtttcctcctgttgattctgcttcttgatgtacacactctttgagccgtcccagtagcagttcacacaccggccatcctgaaaatgatggtcacaattcgggtagccgtagagaatatgggcacattccgggcacagccccatcatctgtgaggagcctttgaaaaacaggctgccgcactcatcacaaagggccagttctttttctgccatagggctcaccagtcccgttcccggatggcctcctcagtgtcaatggggatgccaaaccactccagaatgtaggccacggttgccgcaatacattcccgcgccaccgtttcgatctcgctgtcgttctcgtcaaattcctcctgaagatcgttgatgccgcagaccgcctcgtccagcgtttcctgcaccgcatcggtgtcggtttcgccgctctccaacaggtcgatgaccttctgaagctcgtcctttaccttgttcaccagaaaagcaggatagtaatcgtcctgatacatttcgtccagcagtttgtaattggggtcaaatgctttcatcgtgatttctcctttctcattcaaacatcaaaccgtatgattcagtcaggcttccatcgtcctcgtgaaatatacactggtacacaggctcacgctgggttgctttgcggaaccgctccagaaccggagccagcggctcaccggtagggatgccgagggcatcagacacccgccgtaagctgtccacatccatatcttccaagttacagttgcgctgtctctgcccatactcctccagtgttttggaatccacatactgctttgcgtcacagcagtcgtgccagcagatacagctcacaagcagggaaaagagatcatccatgctctcagccagacggccagcctccccttcgctgctgtaatatccaatggaaccatcttccaacaggtggtattctccgccggagccatctctggcaaaggccatgccgggcattgaaaaggtgcatcggccttccgcgtcatcccgcggggacaactcatccagcaggaagaagtcaaacagcgaatcaaattcatccgccaaatcagggttttcgtgcaatatcttcaaatagtccatagccgttttcctccgtttacggttcttgggtcatttcgtgcagccgttccagccacagcgtttcttcgatcatctcatcattctggtaaaaatggtctttgtcgcgggccagatgatcagcaagtggagccgcgtccagcggggtacataccacaaaactgtcccgatccgcccccttgatctcccggttgaggtagtacacccgcctggcatcgcgggaataccagtgcccaagcagttcccaggaagtcagctctgctttgggaagctgtttgccgtaggcatatatccgcttctcatctctggcaaaataggtatcgcccaaggagcggaaagaggacacctccgcgcccttgatgaccttcaccttgccgtctccgttgtggaagtagacctgccggctgtcctttgcatatccctggggcgcacccgaatcgttctggccgttgtccaacacctggaaagctgccagctctgcatctgagactctcccgctggtggtgtagacggctgttttgtccatcgcgtaggcatagtttaacacccgaaacgatgccgggtctgctccacgcaggcgaatcccgccgagaaagcaggccgcagaggatttgccccagtaatgccagcagcagaagtctttgggcgcaacctccttcaacaagccgttttcatataggccagagaaatagacggctccatcccgaaggaaaaattcgttgtccaccggctctgtgttggtgattggttgcagcgtttcttcctgctcggctgtgatgctcaactcgatatcatcgtcgctgtaaatcaagcagagcccatgaggagcctttctatcgaaatgcagttcaatgtcatggtatttgaggatcaaaggtttcccgtcgcttctcatggtggaaacggcatcgggattcccgaagatttctatgacctcatcctgcgatattccgaatttcagcggtgaaatgtcccgaggattctgcaatatttgattgcgccaaatagtaaagtcctgtttcatggttttccgtccagtgccccaacggttttcatagcggcggaatcaaatttgcactgccgcagttcccgttcaatcagggcaaacacatcggggaagcactcgatctcgtcctgatactcatatttcgcatacagtttcccgtactccgagatccagacctctgccgggtagtaatagccgatgtgaccgatgggctgacacttctgaccggcagcctgttcgatttccgccagctcacagccggacatatcccggaaataggcttcttccaaatggtttttgatcccgttgaccaggtaagggaacaaagcaaactcaaagtccgccgcccagttcagctttttctgcgccaggtaccactcgcagcacaggccgaaatatttgcgataaaaccgctgggtggtcttcatcatcgggacgccatgatcggcgtaatacttctccgcaatggagatgtccacttttcgcccttcctgccatccggcgtactccatcagctgcttgaccttgcttttgagatcgccggaaatggggatgcgttctttcgtcacggtggtcacctccattatttctcaagtggataataccaatcctccgggccattgtaactgacctcaaatgcttctgtatcaacattcagttctgatttggctgttcgataagctacagcggcgacctgtttcagaatgggggtagcctcctcccagtagacgcatgatgcttcatcttccaactcagaatcttcgtcttcctgttcctcctcaaaattcaaagaaaaggattcattttgaatctctgcgtagaatggaagttcaaagtccgcaggattggtaatccggatctctccagtgggagcatacatctcggccatactcagattgccggcctgaagatatttctggtattgctctgcttcgttcttgagataccgttccgaggaggcccggctgtcaaagtggacggcgcttaccccagaggcaaagtccgttgtcaggcttatagtgaacaccgtgtaatccggatgctccgctttcagctttttgatggcggtattcacaagggacagcatttcttcctggtaaagggccgcgttaaaattcgtgtccatgattgtgttctcccatccttctgtcaaagttcattcggatacccgatcttatccaggcccgccttgatttcttcccattcattgcgcttagggttcaacgcaatgaccagttcttttgtcaccggaaccccatcagcaagctggcgcacagtctccaaaggcaggtctgctgggtaaaaccactttccatactccacataggtctgtggatcgccatcgatcaggggaagcaggtctttggatgcgtcctcgccgtccatgggattgcagtaccaggtgatgccgtcttccgtccagacgcagaaggtacttttcatctttttgacttcacggctgcccatgagcttttgcaacgcagggggcatcccatccgtcaggtcttctattcggggaagttttttctcccagtcgtagagttcggaatccacaccgttgattacacagccttccggcgcaaacatgacgatcatgctctggtcactgccatcagtggcaaagaatgcctctttgccttttcgccatgcggggttgtatgtatagtggcggatgaagctccattcctcctccaccatgatgatgtccagagctgccagccctttgcagaagtttttcaggcgctccgcattgggaaggccagataaatcttttgtggaaatcatgtggttatcctcctgtctttcctcaccacagccggtcgatcttggtatatatcttactgggttctctgtccgtaaaactggtcaatgagtcagtgagttctgtaagcggcatcacattcaaaatatccagtgcataataccagatcccggtgtcccagtcccggaaccgcccattgcagacagctcgaccataatcaccaggaatcaaatccagtgctaactcattgaggggctgtttttgccctgtcttatcgtaggtatatcgctccggcatcgcaccaatatgccaatcatagcggtaatgcacctggattccagactcctgctgaatcagttcaaaagggtgaagccgcattgtgccattaggcttccattccatcagcctgcgacagtcccgatcaatccgaaatccatcgggcctctgtacgatagatgcaaagtgagtaggcaggccaaaggaatagtaagagaagaagtctttcggcagccgcatcgctctgggatactggttccgttgtgcggcggcgtttccgccccgacagtctttataccattgcaggcggatctgctgaaccagaagtgtgggcagatatttttctctttttcgttcctcagctttcatgagtaatacagaaaatctcctggttcaaatcaaagtagatcaccatcagctcgtcggtgatctccgggttgaaggacagatccataatgaaaacttgctgatccatctcgtcatccaccaggctgccaaaccgcttgagccgcaaaaagtccaccatctcagtaaaggacagcttggatgggtcggttcccggaaaaagatcagccgcaatatccgggcctacatcgtcccggtggaactccatgaaaaatgtcacaacgctatggtagcggctgtcctcgtccgccagcgccgctttgatggcggctttggccttctccgccaatttctccgcctcatccagcatttctcccaccgcatccatggcggtaggatcagctgtcagttctttctctacatcgaagagaaagggcagtcccgattcatcgggaaaggtgaagatttcctcgccaggggtatatgtaaaatcaatgcgtttacaattcagtttcatagatacacctcctcattggttttccagatggggtaatgggattggtgaatagaccactgtatctccgtcattatccatcttgagaatgatagcaaattccgctgtattgctgtcctgtccctttgggagaggaaagatcattggggggcaacgcagggcagcatggttcgtggtattattccaatcttccatggcagcagataaaatgacatcaatgtgtgccaataccttctcaatggaacccgctgagatgttgtaaaaagtggggtttttatgatactgctctgtgatgaagtttttataggtttgcactggcataaagcaaaattcccaatcaaggggatacaacccaagccaatactcatacagtttcataggcgtatccttacccctcaatgttggtagctttgaggccctttttcaaggaaccgtagaccgttaccgcatggtcggtgaacatctcgtcgcagtcaaaccaggcggtgaagctgccgccggaggtgacggacaggctcgtcatgctgatccgccgggccagttcttcctctgtgatggggtctgtttccggatcgcgggggttttcctcatcctgggaaagccagttgttagccagctcggtcaggttctttgccgcaagctcccgcatggctttgtcccaggtttcacagtcggccagcagcttcttggcggcactgcgggcgcgggtccaggagggcttgctttcagcattgacctccagagaaaggagcacatcctttccgcaccactggatttcgccctcgaaggtatcatagtccttgtccagcttcagctcacccagcacctggtcctggatcaccaccggcttgtggtactcgtccagaacggcttgaagttccggacagtcctcgtgggccttgaccacctgggagatacaccagggccatgccaccagatcttttgcccattcctctttcatccggcggatcttcaggcggcagatctgctcgttttgaaagcgttcccagcccttttcgctgttacgctcctcatcggtgaccggccactccagccgctcctctttggtgctgaccttgccggtgtcacaaaataccacgcccagcgtcacaacggtcatttcccaaaagtttcctttccagttatatccgcctccaatgcagcgattgatcagagcgaccacttcctgctcctcgggctcgtacatctcataaaattcttcaaacatagatcattctccttatcccgccgtttgattgcggtattccttctccagttgggtgtaccaccgtttcagcatggtttccagactggtctttccgttgcgatctgtaaaaacaagaaacttctgcatcagtctggggaatagatatttgcccgcttttgtcagatcctgattgagatagaccatccgaaggatacggccctgccgatccagagggttctttttcagcagttccttttcaaagcagaagcgcagaaacaccacattctcgtcgtagaagtcctccaccacagccgcgccaatgctggtgtatgtgatgtcgtacaccaaccggctccagtcaaatttctcggcatagagtagtttcagcgcctttgaccagtgttcctccgggatcaccagcatcctgtgctgggcggtactggagtagccacggtagacgggttccgggtgtcccagcagttcgctcacactgtcggcatagacgaagcacaactcctcgtcgaacaggccgccgataaagttaccattgcagtacagcatatagtttttggacttggccggagagtaagagaggttgtattcctgggagtccaggattttatgtactttgttcaaaaaatctattgatgtcatcggtttgctccttattcctcaaactcgccctcgatcattccgttcaaataccggccagggtctgcgatgaagtcgtcccatttggccagagggtggaactcctcgtgttcgatatccagataccacagctttttgtccctggggctccacagcagcaggtagtcactgtaattgtccatggccgccatgagggagagcagcttttttcgtttccaggtcatctcctgcacatccatgaaggagtagagctccgcccacttcacccattcctgctccggaaactccagccgaagggggccggttttcagatactccaccagcttggcgggcagcttatagggcatgagctgccgggctttttcctgttcgttgtgccagtcctccggctccagggcttttaagtagtcggccagctcctgatttttgttctgcactgccacggtgtaaggccggtcgccgtatttgtcagcaatggtgatgtcggctccttgctcaatgagccagcgaaccatagggaaattgttggagcgggcggcctcggtgactggggtggaggcgtaagggaacatcatgtccggcttgtggtaattgatatccgcccctttttccagcagcagtttggcaagctcggcctgtccatcggacacagcggcccggaatgcctcgccgccaaacttgtccacggtgatcccggcttgctccagcaccgggatattctccgctcgctgtccccagcgcacttcctggaaggcccgctctttctgcttcgggctgagttttgcggcctgtccagcaaagagcgccaccaccaccggcccacaacagcgggcagcggtgagcagcaggggttgttcctctgccagaccgggatcagctccatgctccagcaggaagtggatcatgggcacatcgttccgaaaaaccgcgatctccagcggcatcagtttgatgtattcgctgagctggatgggaacatctaaatccagaccgccttggagcagcgcttccagcttgggagtgtcatggtcgcagatggcagcagccgtttctgggagagtctcccagcggccaatatatgcaatttggtacataagacacctactttcgttgttgtttcacttgatagggaacggtccggcccagcacccggcccttgccaacggcattggctccctcatagattaagaactccgcattgttttccagcggagcgtagtcaatggtatctggatagaggggttgggcattccccaaagccggttcatcaaatgcacactcgtctccgtccagaaagcatacccccagatattccgtggttcctttgacgacaaaatggggacaatattttccactcatcagactggggggagtctttcgcttgccgctccagaagatgacctccacatagagcaccgcccggttttcatctgtcccgatcatgccagtcgctccattcctgcttaatcgccaaaccgctcggcggcatcctggtaaacggtgatgcttttggccaccttctttttctggcttcggatgcggaagtagtcccgtagaatgcgcttcagttccgggttttccaccttgcggggcagcaggctgatgaacatttcgtcgtagctttcgtacagaacaccactccggttgtaactttgccaagtcaccgtaggctttcgaccttcagggtctttggccagatcaaaaagccaccgctcatccagctccacatagcgttcaaacataaaggtcgtgtcataggacccgtagcggtcatggccccaaaagatgaacgcagtcattccatcaggccccaggcgttcataggtccagtcctccggataacagcggtaatccagcatccccagagcattgaacaggtagatttctttgggagtgcccagcaggagcgaataggtttcatacacctgttccttgggctgggtgataattgctttcataaagactggaatcagccaactgccgccatagcgttcatatagttcatcggccagtgcttgtagtcgtgtatccgggtttcgaatcaaggaggcggtcagaatcaaagccggaatcttctccatttcctttggctttactttatagagccccagtccttgggaaatgtgccatgtagtgcatttgtcaccatcataaaagggggtgtgcttgagatggccgatccgttccgcattttccgccagaaaacggtacacctccaacatcttgggggaggctttgcccagcatcaaatgaaaacagaaattcatctgttccacctgtccctcttccagcggttttgtatccgcctcatccaacagcagggagagggttttcaggatgactggggcaatctgctccgatacacaatccgagcaggcatccgacataatatggctgcccatccatttgcccttgaccagcttggcccacagtggggcagcaggggcatactccagctgcgccaaagccttctgagcagccgttttgcacttacccttttctgtattcacaagttggaacagcagttcgccgtttgcttcatccttgcccagctccaaaatggcctgttctctctttacgcccttgggaggcagttgttctaaaatcatcagagtattcatagtgtctcgtcctccttcataagttgtccctgcacctctttgggcaggtcattccacaaaatatcgtatgtaaaatcccgaatctccgggtaacactcccgtgcggtcttttccgcaatatctctattcaggtagtgcatctcttggtggaaaaaccagttgagtttttccatcagccgatagagtcggatctgttcttcttgagtcatggctttgatcctcctacttcaatttcagcacaaatccccagatactcactacaatcagaagaacgcccagcaggaagaaaaccacacgccggtatcctctgctgtggcggtgggcatcccgcgtaccagtggggtcgcagagccagttccagttgcggaccgctccaatcaaaatcacggccccgatgaccactgaggcaatgtaccaatgctcctgtaaaaaagctgtgatctgctcgctgttcatttaggtttcctcctcgccttcgtcgtcgcgtatcacctcataccacgctccgtcttctccgcgcatctgcatggtaccatagggcaggttcaggagcgggataatgtctggatcgatgcggcagatgtcccggatatcatagaagccgcagtgcgactcgtagtattcatcaccttcgccgtacacatcgccctcatccccggagtagaaggcccaaccgctctcccagcccatatcctcgcgctcggggaacagccggtccataatctgcaccttgcacccatcctgggcgacgcggtcggaagcgtagcaaaacagagggccgtcccagtcgggaatgacagccggtttcccttccgctgcccgcgccacccgcttctcggggtcatctgcaaattccgcttccagatactgttgataccgctcatccagcaactgctccacacgctgacggcttttttcagtgtatggtagaagcaggtaggccgcatctttttccgcaatactgttccagacacggtctttggactcggccaagacgatattccggcagtcccggcggtaaatatagggattggagcggttgtcctgagcgtaccactgagcaaagccagagcctctccggtcaaagaactgagtggacaatttcccatccagcttgttcaggatgaacgcccgcaggtccggcccctttccggcccaaaccgcctccaccacctcccgatgccgggagaggaatgggttactcatttggcctcgtttcatagcccagcccaggaagaaggccatccgattgtaggcatccaattcatctactggcaggtgaagcgcccggattttcttgatctgctctgcggcgttgtccatctccgccgggtcgtaactgattttctcccggtctgtgaccacattgagccggtgcggattgatgacctccaagctctcgtccgggcagaggtccagcagggcgtccgagccgtgctccaacttgtattggatctcctcccgatagaggggaatcacctgatagaagttgacttcgtccccgtccggcaggcggcagaaaaaggagtccgtcccaaacacaccaggacagagtaggatctcaccacgcagctccgtgttctccgcgaaggggatgccatcctcaccctcatccagtgtagtcctggattccagccctacctccgggtcctccatggcgaagtgggcggtggccagcatcatccggatgggccagctccaccgctcctcccgacagtccgcctttgtcagcttccagtctcggggcagattgatgagcagctccgcccgttccagtttttcctcccaacgctcctccgggaaacccatcctatgccggctcaggccgacagtgaccagagtgtagtagtcatgctccggccggggcgggatgatggcgatctccagcgggtgatctgggtcgctgtcgtccgtgaggagctgggtatagacaccgaactgctggtcgatatgtactttcacatggccgaggatgtcatcatcggcagggggaatggtctcctgccggatgatcttctcccgctcgttccaatccagttccaaggaattttcctcctccagatactcctcgcagtctcgcaccagcttttgggcgtctatgtcatccggggccaaggacagccagcgttttgcgtattcataagcggtggctgtggagccgtatgccatcaggcaggagtagcccatccgagcattccagtagggatcgttctcaccctgggtgcggacggactccagcagatcaatggcgtgccggagaagatctccatccacttcagcgttctcgccaagagcaccgcggtcactcagcaccgccagattgctgtaggctcggcccaattttagcgtcagcagataatcccgctcccgttctgggatggcttcgatagcctcaatgcatcgggcaaactcgtccgcatcattccacttctcaatctgctccagcagctctgctctttctgcctgattcatcgtttcaccgccttttctgtttcatcctttgccttttttgaagtgtccgctgcctcgccaggtgttgactacgcaggtgaatatctgaccgcagtgcttgcacctaatcatgtgagccataatttcgtctgcccatccatcctcagtctttaccttctccagcggacaggtggattcctctgcaatcagttcaaattcgccttgtcctaccaactgctggatataggcaatacaggccaggtagtcctttggggcatcaaattttctccatatttgaatgtttcggcagtgctcgcacataatggatgcctcctcctgtaaacggttgttgtcagccctgtatatcagcgtcaacggggccttttttcagcgttccatccacagtgatcacatggccccagaacatatcgtcgtcctcgtaccaggcggtaaaacggccgccgggagatactgtaaactcggtgagcaggatgcgccgggcgaactcatcttcggtgatggggtctttctccgcttcccggtcggtctggtcattgtccgccagccactcgttggcctgagcggtgagcttctgggcagccatcgcccgcagggacttgtcccacacctcctgatctgccaccagtttcttcatcacattggtgacacgggtccaggacgctttcttttcaatctccacatccaacgagatccggacttcttttcccatccacttacaggtcccctcgaatatgctcatctcacgatccagcgtgagggttcccagcacttcgtcctccagaagaatgggctttgtgtattccgcccaaatctcctccagtgccggacagggtacgccttcctccagtacctcagtgacataccactgaggttcgtagagggcatcacctttccagccgcgggctttgatccggtagatctggcccttggtaaaccgcttggaatagtcgccggcatcccgttccttgtccgtcagcggccagctcaggtagcatcgaccggagatcacctgtccggtctgggcatccgccatggcgagggcatgggtatgcgccgcccagtaggtatccagaaaggttttgtctgcgctgacaccgtcctggatcagtaccagtttttcctcatcttccggggcgtacagggcaataaagtccttgaccgttctctttttcatggcgttctccttacgcaaatacctgctggtatttctctttcagttccttgggcgccgtcttgatgaccttgctgccgccgttttcagaggctgtgccccagatggcccagagcacatcacgccacaggtaggccagcgcccttttgtcattgccggattcttccggcaggtaatattccagatgccctttgatctccatcagagcatccaggctctcctcattggcgatcagggtgcggaactcctttgcgggcttcagattctgcatggactggacaccgtggaccaacaccggcagggactgagcagtaaacccgtacttcttaaaaaaggtgtgaataaacttttcttgcaaagaggagtgctcgtcatcacagcgatccaggtaatcgcacaccagccgccaccacttcggcccttccagtcccagggcaaacacggcaaaggtgccaggcatggcgcaggactcatcagagaggttgttgtaccactcgtcctcctgcatggccagccgagcataattctccatccggacatggagacggggataccgcaccgcacaggcaaaaagctgatggacacccttcttgggcaggccggggatgggcaggtagatcttctccggtccgcgaaactcgatggagtagctgcgggggaactccggctgctccaaaatctcaatcagatagctgagagcctcctcacaggccccctcgccgcagtccctggcggtaatgcggatggtggcgaaagcgtcgttggccgaggcggtgaaatgctccgtcttacgccgctggatgtcctttggcaatttgccgctgccagctgttttcagctgcttcaccatgtcgggacggagctgggaaaccaggccgaggatgtgttcggttttaagatactcaaagctctgtccatacaccgtgcagcagaccgccacatagcaggcaaagcgcagcagctcttcatccgcatcctcggggcgcaattccggcagtaccgtgcagggcggaaagacggtaaagccatcatcccgctctcccacaaggaagtagcgttcctgtacctgcttttctatgtacttctccaatgtatagtggatctcctgccagcccaccagccgccgcatggcgtcgcagagagagacagcatcctcacagggaaatcctttcaacggcagctcggtcagataccgctccagcagctgatcagggagaaatggcgtcccgttgtggtttcgcaccacggtcgggtaggcggagtgattttcacgggcggtgccgttcagcacatcctgaatgcagagatccgcctccgccagtacttctggtgaagtgtccggtttatgtatcagataataacggtcatttacaccatcgcgctttggtaagctcatgcttgatcacctctgtttagacaataaaaaatccccgcgacaccctgtcacttggacaggctgacgcagggcatgaaaaggccgcaagggagacgccacatccaccagcggatgtggtttcttcttcagccaaaatcaatttttcatatttgaacagaacagccgtggactgtcccagtttttcttccatagcaagacctcgggttacaaatttctaaatgggtatactttactattttattatatcacatcatctgttttctttggaagagagatttgctcctcagccaaatttgtgatgtggatttttccctttctctttcctgtcccggcatactccagcagttctctggcattgctggccggatgccgcacataggcgatgagaaaatcgctgcgctccaccatatatcggtttgcgcggacgatggcaagccgtttggggaccgtttccagatccggcggatagaacagagcgtcgaacgcctctggcagatccacctttctgttgactgggtaatatggggtcatcagcatcagcgtaatatccgggtgcgctcgcttggcctgcgacagtgcccagatcaccagacggtcgaagttgccataccgccccaccacaaattcagatacgccatattccgtgatatggcgctctatggtttcaagcagggttgggtacacccgatctggtgtctccctatgccctataaagaagcagcttcccatctgacagccctcatacacagtcgcagtcatattttattgattgtgattcataatagaactataaagccaacgcccattttaataattatatcactaattattcgttgtgtgaagcgaaagttgatgatttaagtgcgaacccgcgacgctcccttatattaaaataataagtagagattggagggagaggatcatggacgataaccgccgctatgaagcgtttgtgcggaaccgcatcacagagctgcgggaacagaagggcgtttctgagcatcggatgagcctggagcttggaaagagcggctcctacatcagaagcatcaccaatggaatttctatgccctctctccgggagctgttcaacatcatggaatactttgatttgacgccaactcttttctttgctcctatggacgatccggattccctgcgtgggatcataggcaagaagctgcttgccctgccggatgaagacttggagaaagtagctgtttttctggactggatcagaaaataaccgctcctactggcgtttgacatgaaaaatatgccgctcagtcagttcctgatagtttctgacatgggcggtttcttttttgcgctcttgggggaaagaacttccggctattgaaatttcaagctctttccactaaaatggatttcatcgtctgttatcaaccgttccgattacaaagcgaggtaggaaaaaatgaaccaaaaagaaatcaatgagctgcggcgccgttttcgcccggaaaaaagcgccatcagccgtgtttatggatgctatgtcaacagcagtaaagagatcgtttccgatctggacgaatccctgggcatgatgccgcaggaggagtccgagaagtatttgagccttttgaagaagggactgtccggttccctggggaaaaacctcattgatatcgtattctccactcagcaggtagtggacagtgaggaacaccgcctgctcaccacactgcgggattcccagcttaaggacaacgaggcccgccagaccttttaccacaaggtaattgacagtctggacatgggggacagcagttacctgttgctcctgacctgtgacagctacgatgttccccatcggggcaaggatgattccctgcaagcggatgcctcggatgaggtgttcacctacatcgtctgtgttgtgtgccccatcaaggagggcaaggtagagttgggatattttcccggtgacaatgaattccactgtgctgccgggcaaaccgtcgctcctcctgagctgggttttctcttcccggcattcgatgaccgggcagcaaatatctataacgctctcttttacagcaggaaggccaatgaaattcaccaggagttcattgacgcgatcttccatgtggaagcgccgatgtctgccgttgagcagaaggaagcattccagtcagctctgagcgatgcgtttgactgcagtctggaagtgatgcagactgttcatgaacagctgcgtgagaaaatcaaggagcacagggagagcaggagttcggaacctctggagatgagtgcctcagaaatagggcaaatccttcaaagctgcgggattgcggatgaacaggtggcagcattccaggaaaactgcggcgagcagtttggttcgggggttgtcctgaatccggcaaacctgatcgacagcagccgctttgagatcaagacacctgagatcaccatttctgctgatccagagtatagttacctggtggaaactcaaattatcaacgggcgcaagtacctcctaatccctactgaagatggcgtggaggtcaacggttttgctgtcagcattacagctgcacagaaagacgattaaatttcaaaagccggacacaacgcaaggcggtataacctttaaggccagatattgtttgttattttctgtcttaaataaaatccttagagtgggcgcttctggttggttcattatgaaccgggactcggttcacatgatatgtagaccctccccttggcgggagggtctgctttttacaggctatctcaccagacggtttcttgcttccagtgctgatgcgcagtcatggcctgtcaaatactgtgccgcatccagccattcctgttcgctgcatgcacctaaagggatcgcggcagtgagcctgtgcagccgttcactttgctggaacagccgaagatcagaaagaattccgcatcccatttgataagccaaataatccagtagatcgatctcaaccagcattggacacctccgtcataccacatgatacagattggaagtaagactcccattctcccgccagcgtgggtccttttgcagcagaccagccctgcagagatcatccagtgcccgcttgaccgtagagcgggaaagccccaactccagagcaatggttctgatggccggccagcagcgtccctcgctgtctgcccgatccttgaggtacatatagacgctcttggctctgtggcttagattggaattgtagatatttctaaagctgttcattctgtttccctccgtcaaggccgaaataccgttttgcgggaatccggtgcggcctgaattccctgagccataccgccagcggatgtgccgcctccctgcggctgctcactatccattacaatcgtcccatagtggcggcggatgatggactcctccaactcctgtttgtcagcataggcaacgaaccgctgggccttctccggtacttcatagggcatgccgaaccggatgccccagtcaaggaacagccgcagtttgaccttcattgggtggacgccggtcttggccacaataaagctgcccttgggcatggacttaagttcatccggggtcatgaggggacgctccatcatctggagggactggctgggatcgttttttccgcgggagatactgccgctcattaccgtccggctgcccaaagatttggacagttccaccgcggtctgactggccggggcgaagccgccgtaaaggttgacctggcagttgtccacgatgatctcagagccctcttttccatagtttttctgcagctgtcccgtaatgctctggacgataggcaccagcatgagtcctctggaccgggaggcggaaaacatcagttccagcgactgaatgggcgggcaggtgcccaactcgtccgcgaagaagaccacccggttcttgagccggccgccgttctcgtcggccacagtgaggatctcccgatacaggttttggaggatcaggctgaccataaaatacttggtctggtcctcctcgggcagtacgataaagatggcggatttctcattgcaaaacttctccgcgtcaatggcggtgtcaaagcagaggatctgctccatctccgagtcgaggaaggcgtttaggcgggacagtaccgttgagattacggaggccatggcctgctccgccgtgttgagggcggacccggcaaaccagcgggccttatgattaggcgggagcttttccagcaggagctggaactgattctttcccttcacccggctgggggccagcagttcctgcaccaacttgaacaccgacacgatgtggcgcttttcaatgggattgccgtccgcgtcctcggtgggcaggtactcggccaccagcaggaacatggcagtcagaaggccctcggcggaatcgtagaaaaaagcattctgcccatactgggcgctgtcgccgccgctggtgttgatgagggtcttggcgaggatcttggagtatttctctgccttggcctttgccgccaggtttttggggtcggctttatagatatccatgtacttgttgatcagatgaagcaggttgttgccgtccgagcgggtgggattacgcagatccaacacggcgatttggtatccgtagcagtccttggcaataccggcataattgcggaacaggtcgcccttggtatccgtgcagaggaaggacatcccgctggcgagggcatattcgatgttggggtacaaaaagaacgcggtctttccggcgccgctggcggcggtgaccatggcgtggatgtcatcggtgtccaccagagctgtaacatggtctttgggcccttcgcagccaaggacaaggccctgcttttccggcagatgctctcccttgcgccacagctctggttcaaaagggacatgggcataggtctgccgaatctcctgtttggtagcccagcgtgcggttccgtgctggccgtcgcccacagtcttggatttgattccgtcaagggtatagtaatgggagagaaacgcgaggccgccgatcacgagaaacatgatggcgcctaccacgataagtgttataacttgcgttggcacatgatcctccttttgatatctacgccttaatatcagaaggggatgttcagttttcgctttgtctgctataataaattggtatgaggtgattgctttgatttgcgcatgtgaccattgctactatctgtttgaggcgccggaactgccggagcaatgcccggactgtggaaagcaggcaacccggccagccaataagcaggagcgggcagaatatctcagcagacaaacaagcagccaggaagatgcggaggagtgggactgagccattcctccgctttgctgtttcaggcttaggccatcactggctcagtttccctctgggtcttttcctctttctgccgccgtttgatctcgtcggcctcgtacttgaccggcaccttggcacaggagatggccagctccagccatgcgctggccacctcttttttctctgcctgggtacggataccctggcgattgttcttggccaatacgctttggaattgcatggcgatctcatccgcccggttcttgaggatactccggttctggtgaggcaggatgtggctttctaaaaaccggactccctgctcaacggtcagcgcggtacccatctgtttgcactcccgcagcaccaccgagagggacagcgccgccatggtttccatgtgctccatcgcctggtcaaagcgtccccaatgaaggtcgttccggtactgcaggagcaggccggggatttgataagccgcccggtccggctgaacttccttgcacctggtcccgattcgctggcagacgaggtctgccgccacaaactgcggatgctcctcggcgggctgtgcctccagtccatgccgtgctttcagatcctcgtcccagtctttgtattcggattgcagcggggcaatttgagaatagccatgctcccgcagaacatccgagagccggccgacggcctcaattccggcagcgtcgtggtccaggcagaggatggttttccgcagatttggatttttctccagcatccacagcatggcatgttccgccgtaccacagagagccacatagctgtgctgctgccagccgtccgggtacagggtgagaaaggcaagcagatcgatgggggcctcgaatacatagagacggtcgctggtaccgacccagtggaaactgcaccggggatcactgccctctatgttgccccggtagcttttgccttgggtatagagcccccgcttgtgggcatgacgggcaacgccgcgttcatcgaatccgacgaacacggcgttgtgatacacctttgtctgatctatggacaattcccggctctcatagatcagtcccttctgtgcgaaagcgcttagtacctcccggctgatgtgcctctgctggagcagataagcatatacccgccgcatggcctggtttgagggaggcagggcaaattcctttggcggctctttttcttttttctccgccggtatatacacctccccctgttcaccattgagcagacgggtcactgcttcagggtaagtcaggccgtagaaattttggacaaaggagattgcatggccacccctttctgcagcatgatcataccactcattcccatgcacagtaatactgtgatctgaggtgaggcgtttgtcctggccggaggagatgagtttctctccctgccggcgcaggaactccaccaggtcaacggagttggcacggagtttttggtcctctgtgaagtggatatatggcacgctacatccctccttatcaaaaaagagaccgcagtatgcggcctctcaaatctgtgttaattcattcggttggttggcatctttcggagctcttggacttgatcccaacgcccatagaccacagcgatagtgtgactggaaaggtgcctgaaagggtaactgaaaaagagaaaaagatttcagaacttcttgttgaagctccagaggctattaatgggagtccgcaggttcatacctcatatgcctctcactgattccttcccttgagtttccggtggaacagaacaggtctgcacgggattggcttttgccttttcagcccttgaatgccttttggctgcgccaataaaatctgctgtttaaactgcactttctgtttcaaaagattacctcccttatagctgcatttccggctcatggtcatccgccttgtggccctgagcgatcttcttcgccttgatttttcgtaggagcttccgatccaccgcgacccgaacgccaccggagggcggtggttggttttgctcctggaaaatgttggccagatggtggaacagcgaaatgacggccgccacaggaggctggcccaagcggtcatccatgtgtttcaggaaatattgagcatattcattgccctgatccgctgccagctggaaccacttgatcgcactggatctatcttttgggacctccttcccaagcagatagagcttgccgagggcatactgggcgtattgattgccctgttccgctgcggcggtgagccagcggatggcggctttcacatcctttggcgcatcttccccctggagcagcagcttgcccagccggtactgcgcaaactgattaccccggcctgctgaccgcttcagcagacttagtgcttttacgctgtctttgggtgcatcttctcctgtgagatagaccagagccagggcgtattccgcatacccgttctcctgtttggccgcggcagtaagccagcggatggcggttattacatcctttgggataccgtcgtctcccttcagcagcagttttcccaggcggtactgggcaaactggttcccaagttccgcagcgtatgtgagccatttcagtgcggccgccgggtctctgggcagggctgcgtcaccggcaagatacagcttgccaagagcaaaggcggcgaagctgttttccttcgttgccgcaagtgtgaacagagccaccgccttttgaatgtctttttccacgccctgaccatcccgatagattttgccgagcgcgtattgagcacagtcctggccggcttccgccgcctttgtcagccgctccaatgcctgggctgtctgctccggtgtagaggatggatcattgaaaatcatccgggccagttggtactgcgcgtggggattgtccagtttggacgcctgttcaaaccactccctggctgccgtctcatctttaccagtccctacaccatggaggagcatccatccgatgcggtactgcaatttatcgtcatggctctgctgttccaattcgagaaatccggcgaaggcttgccggtaccactgttccgacgcttcggcgtccttctcacagccaatgccgtcccgatacatctttcctaactcgtaggcggcataggggaagtcctgctgtgcggaggctgtgtataactccagcgcccgcgcatcgtcctgttccacaccctgtccacggcgaaacaggccggcaagggaatattgcgcatacttgtaccctttgtctgcggaaagttggaaccaccgggcggcatcaccatagtcctgctcacagccgaggcccgcggcatacagtttgccgatccggtactccgcatagcgttttttcttctgcctctcaacagcatagaaagcggccagcgccttgctgtaccacacatgggcggcctgcatatcaatcttccggcccagcccgtccgcaagcatccggcccagatcgtgcatggccagcgcattgcctttttgcgcctcctgttggaacagggtaaacgcctgctcaagatcctggggctgatccttgccgccaaacaaacagcggcgggccaggcggtactcatcgctccagttcatctgcgctttggctggcgcagacaccgttttgtctgggacatcgtccggtggggactccgagaaatcattccagtcattatcaggctggggcgcctccggcagcggcgcttcttcctggtcctccacagggacacggtcttgctggtcatctggatggaaaacctgctggcgcgcccccagtgttaccgcttcctcaatgacgatgtttttgatccgcttgaatgccttctgctgggaaaggggaaggcgtggaggcaggtcatccttgtaggtacgcagcacatcttcccgcagctcataccacagggcataggctgcggcgacacatggctctttggccagctcgtccacaatctcatccactacagccttcagcggagccttgaggtagccgtactgcttccggcctccggtgtgccgcaggcgttccgccagatgctccatgagcttctccatgcggtggttgaccacggcgccgctccacatctgttcaattaactgctccagcatagagcgggcatcctcattcagcgtgtccctactctgggtctgctgctggtaaagctctgtcagctcctgccggaagatctcttttgccagtcccgacttgatttgggcgatgccctgcgtggtgagaaagcctttcgacggatcggcgctgtagcagaccatgtggatatggggatggtgtgcttcatcatggaatgcagcgtaccaccgaaaatcctcccaggggatcttcatcgcctccgccatttccatggcatactcggagagcagtgctttccattcttccgccttatcatagccgagacgggcagcgtcttcccgccgcagagagatgatgggcagccacacattaccggggtgggccgcgaccgcttccgctacctgcgccagtacgagctgatcttcctcaccggtaaacaatccatgggaaccgacgcgctgggcgcgggggcgggtggcgatgtacttcagatagttatccttcttggcgatctggttatagttgtcctccagagcgcgagtgatgaactccgatgcgttggtgcgtgtcggctcggccgcatagtcctcgtattcaaacatcccacggctgagcgggaagtcccgcaggatctgttccaccatctttttctgctttgaggtggccggccactcactgcgtcccggatcgatgcgctccacaccattccgtgtggccatatatttcacatagttttcaagatgagcggtggcggaggaggtaccgcccttgatgtaggggcacttgaaaatcaggcgcggcacagactgtcaccacctttgtgcatcactccacgccccgctggtagtcgatggcgtccttgaagctgatgcgcccattggtctgcttcacttcacggacggaccgggcgcggagtgtcttgagatcctcgtcactgatttccatgcccgccgccagtacattcatcatcatgttgacctccaccgccagtttgaagagcaggcgggcgatgcggttctcactgtcctggacggttccgcgcatggctgccaccagtgcgggcggcagatatgctgtggcttccttgccggaaacatagccggcatagaagcggattgccttttcaataaactcgttctggctctggcagttatccctttcacagagttctttgaccagttgctgtgtttcgggagcaatacgcagagcgaacttgattttttctctcgccatactttcctccaatcaaaaatccctgacctttgcatggccagggattcgttttctttaagaggcttctttacttcaaagctgaatgccgcccatactttgcttttgtgcctccttttctgtccatatccctgttataatgccggataaacgccgaagtgatgggccattccagccgtggtgacccccggtgtgatcccatcccctgaaaagtgacccccgcaaaaccgttccccggcccgcattgcggggcggtgtgagccgagcgggggacgctttgcgacccccgctctttatcctgcactgttttcgacccctcggttcaccctcgctaaaggcgaaagtgagaggccatcaacgcaggacggtcactgctcattttaggaacggcccgcacaaagcccccacaaatcgccgggagggacggcaggggtacggatgccacccagccccggaaaagggcacaccgggccgcacagggggcaatggcgggggaatgcgctccacttcacaaaaagagccgtgctgccgcacggcttctcatggagcatcggctattggtttgctcagttctgtgtgcaggccatagacacctgggccccctcgttctctgtctggctcttgatgatccagtccgtcaggttctggcattcactcaattccctggccagtgcgtacatttcacggcggccatcggcgctgttcagcttcactgctgtctcgaacaagccccagatattatccagggtttggaggccgctggcgtttatcggcaggtctttttcctccatcacatgattcaccttttcgggctcggctgcttgggtaactgcgatttcttcctgacggatcaagtccagccaccgctgtgtgtctggtattggaagtccccatgccgttccaacctgtgtcacagcctttcgatatggagttacatccacagctgttccatagagcataaggtatgcaatggcctcctttgcgagattttcctgcagtttacatacttgtttggctttcattcgttgaactcctttcctcggatttttggtttgtttcaggcgccggttggctgcccatgcaacaacacaatgccacacttccggagagaaatccattcatcattgccaataaaaagcggcttgagaagctgtgggaagtcgataaaatttaccgagcggcgtttcctacagccgaatctccagcccttcttccgcctgctcccgcagcagggcggtccttgtttcccccaagctctgtccattctgttggtgacagtaggcgtccatctggttccacaactggacctgttccgcggaagtcagcgggtagaaaaactcaaactcatgaccgtcagagcagacgagacatacggtcaatgcgctgtctatccgcccggtcttccagccaaaattggcgtacacattcagccagtcatcgttgaaggcagaggcaacattggtaccaaatactgcgtcaggatcgaagtttatggggatatagaagttcagtttcccatcgcactctgtgatctcatcggtgaaggataccgcatctaccggcagccttttggtacctgcagtgagttccggaggggcttcacgctccatatccaactgtgcgtagtaatcgttcagcgttttcccggtcctgccgaggtagtccgcttccatctgttttcgcaaaagagcccgttcttcttttcccaggggataggtgaaaagtttctgtaccactccatcctggcgatgtagagtaagggaaagggtggcgtcggcctcctgccgtgcggcgtcgtaattgcagagaatatccagccagccccccggctctaaacagtccgccgccgggccaagaacctcccgctgggcctcatcgctggtgaagtcaaactgaaaattcagtccatggcctgacagaatgatctcctccgagaaggtaagatcgccctcccgcagaggtcggattcctctggtttcaatcgaaccaaaggtctgcaattcaatattccggccgtacagataatctacaagtctgcgccattgttcgtttctctggaggttgcgagttcggttggcgtggtaggcggccgtagatacatccttgtttttgaaggtctgccaaccgtctgcgagattcagcgcggaacaccagccggcatccagatcaatctcaaacgcacctgatactttgccagtattttcgaggcgcaaggcggccaattcatcaaaccgctcccgcgtaatgggctgtgtcttataaaagtggtgggagaaaccgcccttcaccgcctcggcgtctccttgcagataacggcgcagccgtatggccacatccagaaattcctcgccattacccgttgagaagatactgtcatggccattctcccgaatatgaaaagccgcatagactttctggtcttccgctgcctgtgctgactccagttcttcctttgtgatagctgtttcaatctgtacccaccgttctaatggaacagtttcgttgtacagcgttatcaaataatcctgcagatgccgtttaacattactgccttgcgccttcagcgcctcctccagcgccgcccagcgccgctgatccagccacgcctcggtagatacagaatcggccattattcaacccccttcttctcgtcaaaagtatccggcgcggcgcttcgaggggaccgggcaggccgcgggcggggctgttcctccggctccgccatgctttcaatatactccctggtctgagaaggcacatattttttgtagagcttctccatgaacatatccagttccaactctaaagaggtaccgttctttcccgcatagaactggacggctttgagtttttcctgctcaaatgaaaccgtgactgtggcttttttcatcgtgatccctccattacagaaacagttccatggcatgttctgccctggaactgttggcaagtgtttcatcgtattgtgccagaagctgtgaattgacgccgtccagaaccagttccactccataggggccggggcggatggcggcaatcttggcatccagaagagccgagaattcttctttgccctgggcggtcagacggggaaggtccgctgcgggcacccagccaacatcttcggcggcatgaactaaatagacatcatgatccggcagtccaagtgtcaacagatcccgcagatggacggccggggcttccgccagcgcatggagctgctgctcctgcacaggctctggtggaaaatacactctggtttcactgccatccctgcagaaataatcgacctttctccactcgccgccatgggcaacctgcaactccccaagatggctgtatctccagttccgattattttccttgcaccactggactacatggtcgctgacgctgccggacttccagtcgaaggtgaagagagtttcacccttctgccggagcagttccgtccactgtacccggtctgtgaagcccatacttcgggcaacaaacgcctcacacatccggatcgcccagtcggacggctctgcctgatgttcatgtttctttctgaactcctccaactgccaaagcagatccaactgatcctgtttaatattgatgtttctttcctcctctttcgtgtcatccttggactgtttatccagcgatagattgtttccaaaggcttccgtcaagctctcgtagatgctctccgtatcccattcgccagcggcagtcagccggccagcgatctcccgcagggtcgtttcctgggcaagcatctcatcgccggagataagccagggccacatcttcgaggtttcctgctcaaagcgaatgtagtccacgatgtcctggtatgcgtcatcgcagtcaggctcatagcggtgggcgagatcgaagcccatggcctcaatctcctgattagtcagtcccaactcattgtgaagcgtcttgtagagttcctcacttccgtcatgctccgcaaggaaagctatgagcctgttctggattctgttggcgcctgccgttggaaaatggtttgccagggcatccaagctctcccgcaggctgccggcccggtggtcatattccaaccgtattcgcccattgtccagatcaatgaccgcccgctgttccgcagccccgccatgaccaaggtcatggctcagggcctccgcttcatctgcaaatacccgcctgagtggagtgccgcgttcagcggcagcgagagaaagagcctccgcgaagctgctgttctcattttccgcgatggcagcggcccgcgctaacagtggatacagccccacaagcccagctccatcctcgcctacaaaagcggtttgccgtccccgttgctctacttgatacagcactgccgtagtatccctcccatcgttttattaccgtgttctgtctgttttacatagagagatcctgttcctcacccatctccacatcccacatggtccggacctcattcaggtaatacccagccagttctttgtcctcgcaaaagaaggggacgatgccgcggaccccatagtgctcctcaccaaccgctgggttgtaccgcccaagcacatagtgaagggggactttttccattgtgaaaaaagttccccgcacagagcaagtcttgtccttttcatccacgctctctattactccaccgcgtagatcgaaatcgccggggcctccatatggctcggtagcgacaaacagcaccttgtctccagccgtcagctccttagctaacaggcagtcccgcatacgggaaatgatttcatcacgggaggtgaagctctcggcctcctggatttcatcgctctccagttcgagagcggacagagcctgctggtacgcggtatgaagccgttcatccggcacatttgggtcaaggcagtaaccgaaagcccctggagccaggcgggtgattcgttcctcatctgggatctgttgtaattcttcataggcggaaagcagattcaccagcttccctgattttgggagaaggtcagactgcacctcagatgcttcgatctgctcgtccacatattcatcatacagagcgaagccgaggcatccaatttcatcgttgcagatttccaatgtgttatgaaggatatcgtagaggctgctgtcatcgaaatactctgccatatagttcagaatgcctgatatgatctcctccttccgctctgcggaaagagagggggcgggctgctccggcgccaggtttttgcagtagtccagataatagcagacatcaaagcactcgtccgtcagggtgacatccgccgcctccggccgctgctccagcttctcaaggagcatggtatcgaagccgttcccgtcctctatcaccaatcccatttgctcataaagctcactgaaataatagcaccagctaccctcgttggtgttttccgctccctccctgatgatcttttccactgcctgctccagaatggaatcaaccaccgctcttgctccgggcaagtaggcaaagtgtttccccccatcataggcaaaaactccgtctttatgcccctctcccaaaacgaggacgccctggtagatccgtctaccgtgttcatcagcatagaacggctctgcagcccagcggccatcctggtgagggccattcaaaaagtcttggaattcctcgtccggcagcgtaaccagccgaactgcctcacactcaaagatgtggaagcgtccggccttggccggcaattgaagtttcagccgcaaaatatcatcctccagtcttcggtaaataatagcggggattggtacgctccccattgacccgcacttcaaaatgcagatgcggacctgtagacctcccagtggaaccggagagggaaatgatatccccagcctccactgtctggccaacctgggccagtagacgggaattgtggccatacaaggtggatagtccattgccgtggtcgattatcacatagtaaccatagctgctgttatattgggaaactgtgaccgtcccaggcagtgcggcccggataggggtgcctgtgggtactgccagatctatcccggtgtgtccccgtgtctcgccagtgaaggggtcgctgcgatacccgaactccgaggtgaccacggactcccagcctgctccgatgggagagcagaagccatccaccccaatgaacgggacatcagccccagggaaccagccgccgctttccccgctggggctgccataaaggatgagatgatagatactgtcagcgttggcctgatggtccgcggtgacctcgactccaatggcatggctgatccgctcataaatttcagccaggtcttcaataggaacggccaccatgtaggtttctgtggtctccacctcattgccttcttcgtcggtggtggtaaccgttcgggttcgctcctcataatccacgaaacagtccgcaaactcatggatgccatctgtatctggctgttctgcggcgaaatacagagcataaaaaatggccttgacgcgggtatcgtcaaggctttttccatcttcgcattgactattgatctccgcgatcacttcgtccagttggtcaaagctgttccgcatatcctcgatgtatctttggtactccggcgtggcgctggcggaaatggagccgccgtggaagcacagctccacggcggacacattgtgctgtgaggttcctgagaggatggcgcaaagcagaaccaccagaacgatcagcggggaaaggatagccacaatgccccagcccacctttttgcgggcttcctcattggaaagaattactatcgccgctttgacggccgctgcaacggtggcactcataggttcatacctttcatgggcgaatcctctggctgcgtactgttctgcagttcagaccagtacgcggccagctcctccatggtttccgtgtacccatcgcctttgggccgatgctccgcccacagctggtactgctccagatcaattccccggtccagcaggagcttggcggctccgaccgcctgattgctgacacaggcatagagcgcgtcgtagttgtccggctccaccggcatcccgtgttccagcagtctctctgccatccactcctgatgctggcccgtgagggtgcgcaggatgccggccacctcatcgcccggtcggacgcccttgtccaccagatccaccgcggtctggaagtccagcttttccgcaacccagcggagaagcttcgggggcacagaagcaatctgctccggcgtgcattgggcgatcaggtctttggcgatgttccggcagttatttgtataggcatagaggatcacctcaccgtggagggaggggagcggctccgagaggcggccttctgattccttcaccaatgtttgtacccgccaactgtctcccgtttccaccgcccgcttacaggcagtgagatatgcctccggggaaaacctctccaccgccgcaagaagtatcagggtcatatttcctcccacgacaccggggcgtcccgccacctcgatcagcaggtcatccgtctggtctgataccctgggataaaggtttttgaaggcgtcaaattctccgtcccgaatggccaacacggttttatcgtagtcgctgatgtgcagggggtaccgtcccacctcatccatataggcggtgatgctcccggtcatccgccgcaggagctgttccgtctgggacatggcctgttcctggcgttcctgctgttccaccagcgcctcgatgatggtgcgctgctccgtaggattcaggtggacgatcatgccctccggctccgcccgctcaccctgacggagatgtcgggcataggtttcgccgtccccgtggaacgccttggtgatggcggaggagatgaggaacatccggtccagatctgcgccggtttcgcccagcgtcttgccggtgatgaaacttttggtgacggggcggctgtcttcataccacttcaggtacacatctaaatagacgccctcgttgccgccgtagtcggtggtacagaagatgtcggcgtctttggggatctcccggccattttcccattcccggtccatgagaaaatactcgtccggaagatatcccatactttccagacggtgcttcagttcctcgaagacttcctgtgcgacgcgctgaccggcatactgcatcctccggggatctcccggaaacggctcccactgctccaattcaatttttttcattcgaatttcctttctcttttatagatctgctgttggcagttcacccttcatacagcaggaacagggcagatcctcatctgagaaagcgcccggaatcgccagctgattttcatccgcgcagataaaatcccgccaggcccagttccggcccaacccccgcactgatgtgaggtttggcatggctgcgtcttcaatcgccaaagcccgccgcagcaaatccgggtagcggtggtacaatgtccgaatttcccaccgcttcatgctggggcagaagaagcaggaagacttgcccggcaggggaaggccggcatcccggatcgcctggatgcagtcctttcggctccagccccactccatcaggggatattccttctggtattttttatcctgaaggtcatgaggaagggcgttgagcagacggcgctcctctccggcatcgtatccaatgaacttgacgaccttttctcctttctcccaggcatcaatgcagggctggtagtgcctgcagaacttttcctgcggggcaaccttgtgcttgagggagcattttttgtacccataagcaatggagggcagcgttcctgagcggaggcactcctgctccagcgtcagcctctggccgttcttctcggtgtaccacacccgcgtgatcgccggcatcccatggttctccagccagcggctcatggtgtccaggtaggcataggtatgcggctgctcggctccgggatcggcaaaaaggatcaggtcgactgggacatggtgccgccacagtcctaccagcattgccgtgctgtccgttccgcctccatacccaaccacattcatcgcccgcccgctgtgccgaacagcgcctccttataggctggagcgtgaacctccaacagataccgctcgttgccgcatttgaacaggcacacaccccgttgggggaatcggatgaggttgtactccgcctcctccagctggagcagatccatataaaaccgcttgtcaatggagccgcagttgaagatgaactggtggggcgggatagcgaacaggggcttggtcaactcccggatgccctcccggtcaaagtcctccagattctgcgaggccatgatgaggttggattccttcttgcggacccgcttgagagtgttgcggatatactcgatgatggtggtacccaccgacacattatccgacagccacacatacagctcgtccagcgccgctgtggtgttgccgatggtcagcaggcggtcggacatataggacaggatgttgaacagcatggcgccgcgcacattcttgctggcctgcagcagccccttgaccccgaagacgataaagcgggaggaggtcacattggtgtgcccgttgaagaactgagcctcggcgccctggcacatggagtggaggcccagcaggatctcctgcagcagttccgctgtgtagagctggtggcagttcccatcgtactctctgtactcctgctcaatgagtttatagaggtcggaaaggatgggatagtcctggggcttgaggccggcgaagttggtgctgtcgctgatgccccatttggcgtacagcttgcccaccatgatctcaatggcgtcgatgtggcggtctgagaaatccttgtaggcccggaaaaagtccttgagaaaggagatgtgctgggagagccgggtggatttgcggaatgcctccggcgcgtccctgtcctccgggccactgccgtcatcccagcacttgggctccagcggattgatgcggtacacgccgcccatcagatccatgaagcagccgcccaccgtctcacacatatccttttgttcgtgttccacatccagggaaatcacggatttgcccgcctcgaggaagttgagcaggagcagtttgagcagatagctcttaccctggccggagttgccgaggatcaggatgttggcggaggtcttatcgtcatcccgcttatcaaaatctacgaggatattggccccgtacttgtccttgccgatgtagaatccgtgaggatcggtcttgccagaataattgaagggatacaggttggccaccgagctggccggaaggacccgttcaaattgggcgccgaaggcgttgcggccggctggcataacagaaacaaagccctcctgctgacggagcataagccggtccacattgagcttggagcgaaccagttcggtgagcacatcggtctggagcagcttgagggcgtcgtagtccggggcggtcagctccaggaacaccgcacagtggaggagcggctcccggttgcggtgcatggaggagaccagggtaaccacatcctgcaggttggcctcggcagtgacagtctgctggagatcctcggtgctggagcgggacattcggtgcttgttggcggcgttgtggatgatccggcgctcctcactgggggtgacctgccgggtgtagatgcggatggtgaccccgtccatctcgcccagatgccgcaggatggcctgctcatcggtagaagtggggtactcccgcagcgcccatacacagcggcaggtgttgccgcacaggtagtggtccaccttgaagtcgatgaccgagggggcgaccatgtcgaggaaatccttgatatatggttcctccaccacaggccggggagagttctttgttctgtttttcggcaatgaaaaaacctcctgtccaggccggcaggagatcttttatcgcactgtttcttcctgatatggcccggaagttctcctgacggccatatcaattaaattgtggggcacgggtcagtcattcagaatgatccagcgttccccgtcgtaatcctcatatttttccgtggtggcattctgctcaaaatacacgcccagcatgcgcttgagatcctcgccgctggcgaggcttgccttgaagccctgatcctcgaggcttttctggatgcgggagaggtgggtgtgcagctccatccctgtttcctcacgcaaccggaccagtatgaagaactcacgggcggtcgccatctggatctgtagacggtccagtgatttagcgtccgcctccagcagccggctgatgaccggcaggtcctcctcggcagcccgctggcgatagtgcctcttgttgtcctcaaagctctccttggagttgagggccaacatctcgatctcagcctgccccttgaggacggtcatgagggcatagatgcgattgctcacagcctccgggggctggaccgagaggttggtgggcttgatggcaaagaaaatcagcctcccatgactggtctttaggccgctgtcggtgatctcgtcgatcccgatgagctgccgggtagtctgtttggccgttgcttctttttttctgctcattttctatcactcctatccgttgatggattacacagcccccaggcataggtctgctggcccaggaggaaatatcggattgcatagcgcaggaagtccaagatactggtatcctccagccgaatcgagaggaaggcataggccgcagtgattaccactgggggcaggaagccaagttgggccatggcaaacacagagatcagggcgcccacgccaatgatagcgatgtcccgcagttcccacagccacagtacggctttggatttcagattatcgggataaatgtacatgtttcacctcacatcgtcatgctcattccaaacccctgttcatcctgatcggggccgaattcctgatcttgtacttcgtctgggctttgttccatcaaccaagattggagttcctgtgccaccaaccccacaacgaagactcgtttggatacgccattatgcgcctccacatactgctcaacgcggtggaaaagagattcgggcatagcaatggccagcgtccgttctttcttgttgtcctgaaggaccgcactctggagcggttcctcgccatgttcccactgatccagtgcctgattcaaaaggctctgaaccagtgccttttgggtgaggggcgcatgagcatccaggtaggacttcagccgctgaaacatgtcatctgagatctgaacggccagggtgcgctgttcctgctttgctgtggctggctggtccagataggtagtgagtatcttagtgagatactcaccgtttgtcatttcaggacttttgccctccatcagccgcttgtgaagcgactcgggaatcaagccgcagaggtttttcatcggttccatgatcgcatctcctattcataatcattcaagctatctgtgctgtggtcgcccatgcgattccttgcaaaacatagtcgacgcaaggaatcgctacactgttgcccagtgctttatagcgggcggagtcggaagcaccctcgatatcagtccaaccatccggaaatccctgcaggcgctcgcattccagcggggtcagacggcggatcagaagaaccgaggcacctcttggagcggaggcgctgttatctggctcgtccatatccacgaccaaatctgttgcgtctttgtgctgacgagcgctctgagtgctgaccacctcgttgcttttgaacacatccacacgctggcggctgaacacggcatggtgatcggtggcggtgagagtataggcgatgccctgttgatacccaatcccgttcccgccgttcataggctgccggtcaatggcatttccggtgatacagaatatcgtgtccggttctgcgaccagcgggacattgttcccacccgtaccgtaacgggctgacattgtgggcgccacagaatgtgggccggtgtagcgggcatcgatcccgtggttctcgaatacaagtggctggtggccatgctcctgtgcccgaagtgttccggcaacattttcgctgcaggcaatggcgcttccgccctggtcattaaggcacaggatggatggcatacagttcccgctggcggttcctttcaaggtaggcgagacttcctctccatagccaatactgcccgcagaagcaccagctccagcagaaaaagcagctgtaaaaatggcgggatacccttgtccgggcataccgccgcctccgcttagtgctgtgtgccgctcctcggaaaggaagcaatcaccgttgcctttggccgtgattccggccacaaaggtctgctgtttcatccctggctgggcggtcagcgccgcggctacatcatgaagatcccgcacctcgtcccgctgattggcggcaaaggcggtgagcacaccgtttcgtccagtggacataccacaattaacaccgagagtggctgccttttctcctgtcaggtctccgttgtatccgtcgaatccgatggggccagtcccgcctggaggatcagagcatcccggagctgaggcggcagttccttgcctctggcctccgctcgacgcagaatacccaggcaggcggttttgctcaaatagtatttgcggggcggatcgtcctgcaaaatctgcgacaaggaagattctcttgcgacgctgggcgacaccccagaattgagcatccatgactctccaagccaggctgaattgatttcccagaatgattgccccagcagattcccagcgcccggagtcaggtcgaggcactgaacaggagccgtctttaattcggacaatctcctcgaggacgatgcggaaatcttcgccgcccgctgaactgaatgatcctggtacattctcccagcacatatatcgaggtcgaacagtgtgagctgttctgccgcgccgctcatctgcatccctcatttcttttacaacgcggatctgctccataaacaggccggaacgctctccggcaagaccggctctggcccccgccacgctgagatcctgacaagggctgcctcctgtgataatgtctaccgggggaagttcggcaccattcagtttcgtgatgtccccgacatggagtatggaggggaacctctttcttgtcacttcgatggggaaggcttcgatctcgctggcccacaccggctcgatgccgttgcggaccgccgcgagtgggaaccctccgattccatcgaacaggctgcccagcgtgggcattatgccatacccatgctctgccctggagcttcgctttgctccatctcagcgggcagagcctcctgcttgatttccagctccccaatctgtcggatggggatgccgagccgttgggcctcctcaatctcacgggccatgccggaactgaccctgccgccgcagagccacagttcatcgcagacttccagcacccggtgtcccagccgcagtccaatttcccgttctgttggctcagcgtcatccaacatctgtgggtagagcaggtggacggcgatgggcgtatgcccctgatggatggcataccagcacgcctttttcgcaaacgcggtgtttgtctcaatatctcctgcatagggagaggcgatgtaaatcagtttttctctgctcatttcgccgcccccactgcctgtaccacggtgcgggtggtgttgaccgctgactgtgctgcatagacggcggacatgatgttggcgcgtgtcgaggtgtccagcccaaaggcgccgcagatgcggggcacttcaccggccgacagcatcaggccaaggcccagcagcgcatgatccttcagcaccagcagtcccgctgtaaggatggtggcctgcaggaaggtggtcagacacagaccgatgatctgcttgcaccactgcacaaaaccgtccatatagccgcggggcaccgagaacatatacagggaacccacagcaatctggatgagtaagactcctccgcgcttgaggttggagaaaaagcacttgatgacggcgtaccccatcatgatgataataaaaattaccatgatggggctggtgatgctgccaatcccgccgaatacgccggaggaggccgcggccccgatatccacgccctgcagggagttgatgatatcagtggaaagggcatcaaagctctcgccatacccggtaattccagaggtcaggctggcctgcagcgtgacggagagtttataaagttccaccggcaccagggtaaaacaccccacggccataaagcccttgacggcgctgatagccgcgtccttgatactggcccgtccggtctggtattcgattccgacctcgaacacggccaccaccagcccgacgacatacagcgtccaggccagataagaaaaaaagagaacaatggactgtacccagctcatctcgaagagctcgacgcccatgttccccatctcggcaaaaaagttgccaaagaaaccaacaagctggctgtagacccagtcgataaactgatccatcagcccgccaaggaaaaagtccaatataaacatctggtggtttcacccctttgcgtaagggggaccgtgccagcattggacgcatactcctgctcaaaggcacaggggccgtggctgggcacggcccctgcttgtattcgcttcctattttcttagcacatttgcgggctgtgttcctgcgcctcctcctgacgctggaacacctgcagatattcgtccaccgtacccgccagcagcctgtaatccgcctgagtaggctggtaaacataccagtctaccttcccataatcgtcccagaggtgtggtaagataccatccgagaagttgggattgctcacttttttctttcccagtaaatcgccaaagcgtaggatattcacatccaccgcgccctcggtccggttcaggatcgtcagcttgagggcattgtactggccggcaatgttcagagaaacaaactccagcctggcccgcaaatccgggtcaagctggatataggcggatctgcccgcataagacacaacgccgctggttttgcactgagtgaggattttcctcaactcctgtccaaatggattcaattttcttctttccctccctacatggttaattccgggacagtcggcgccggtggatgagctaactccagcgtactgccttccaaggccagaacgccatccagccggtgaataaggccctccatgtgtttctgccatccgtcccaatccttcggatcaaaccagccgccgggcagctcgccggctttgatctgccgctccgctctgatcctggcgtatttcaaagtgtccgcaaggtaatcccggagttcccggagagaagcccttgatgctgtaaacgaggtgacggaccggaacttgttgtcctcggccgcccactcctcatcatagtccaaactgccgggatcaccgtcaagatactttacaacgatctcagccagtgccatagggctggtatgcgcacaccccagctttacatcacagggggcattccatcggtctttctttaatcgttcaagcatttctcccaagtccagttgtccatctgccggtaaattgtaccggacacatctaaccgcatccagtccattgtcggactccagtgcggtgattccccaacagcccatagaaaccgtctcccatttccggcttacgcctcatcattcttgtcctacatttccagtttcggtccaatctgctcctgctcatccagcccaaatgcctcgcgcatttccgcatccgccagaatcccgaacgcttcctgacaatctgcgcagctcacgatccaggtctttccttcaaagtaccggagcatttccgccaatattctggtcttcgggtccgaggcagagagaagctgccccacctcctcccgcgaaagatatttgcgttctccgctccaggagccaatcacgccgacagtgtactcagggatttcctccggcagtattttacaatccagaaccggatctggatcaaaggtgaaaaacacatcaatgggagtatcttctaccacgcttaccccgatgccgtatggacctgcacctgctctgcacatcccggtagaccgctggtacagctcgttaaccaatgaaagcattttatttccggatggatttggaattggatattccattgcttccttcctcctgtattctcagaataattctttacattcccaggatcgtccagacataggtgggagccgtcagggtgaagataaggcaggcaaacaggatggccggcgcagtccattcgaactggccgtgctttctatagtcaaaatacgccatgcccaatttggcgaagaagaacacagccagaacaaggtcaatcacgggaaagaccacattattgacaaccgttttgatctgggcggatgcgtccgtccaagtgccttcaatggcaccagccacatccccggttcctgccgcaaatgcgggtaccgtaaacatgatggccagcatcattaccattacgaccgcacagagcatctttttcgttttcatcatcaaataccacctttctttgctgaaaaaagaaaggccgcaggggtgttcccgcggatggatgatctatcccgaacaggccgcgaggcactttcccacggcccgtttcttttctgattttgttactgtgaatgcttacatcgtgagcacaggtccactcagttcctgtgtttccaggaactgagcccggattatttcttcaaacgcttcctttgctaacctacagaagacagagtacataggcagaccgttctcagccgtgtattcatacggttcaggtaaccgcccgcattttgcaaaaaagttcttttccgcctccataagccgctcaatagaccactcacgtacttcgttccgatatgccaagacggtttgaacatggcgctcatctcttgcggagagaagcgtggggtaacgaagttcagcatactcttgggcggtcgtgtccatatagcgttcaaatgttctgcgtgtcggcagcccatattgaggcttcatttcccttgccactggcagccttctgttcttttctacaaatcccgcaaaggcttcttcgattttctccttggtccatactgccggaagcccttttttgcacattgtcaaccgcctctttacatcaagaaagaaatatctaaaaactgcgtttgagcagcctcgaccagtggggctacttcaatgacctctggattctgttggaacttcaaatctccccggaagcccagtttcaggttactgaatgtttcggcggccttcagcagttcgggcggcgatcctggaggcatctcctgcatccactgtacccattcacctttctgaaagcggggatttagccgaaggatcacatagtcctccggcacaaacttgggatagcggccgatgctgccgcccaccttatagtagggctttccctccatcatgaccgtggcccgcatgagcgtcagggtatcctccaaagaggcgcaaaaccagcactccctatcgcccatacgcctgattcggccatcccgcaggatgctgtccagattctttcggtgcgtgtagtggtagacctcgccaggctgctcatccagtcggatgtatcccatggcttcacctcccgcctatagatcaagcggagcgatatgccaatcgtcccatagattgccccggatattcagtgaatcggtgaggttgaccgagagcatccctgccggggtccagcagtcaatgacccaggtgttgactgtataggagccatccgggtaccagataggagtgaaatgggtacgccggttataggtgctatactcgttcttctggaactccagcctggaagacgaggaactgatggaaatgcgatccaatagccgccaaaaggattcatagttgaactctgggaagtaactgactgcattctgcagggcggtggtagccgacctctgggaactgttcactctggcggtgaccacctgattgaccccatagccggacttcatggtgctgtcgctggcggtgggattcttctcgtctggagtaatttccatagcagcggaaaggctggcactgtagcggtccagatcaaattcccaccagccgtggtcgcaccagtatccgtcctcatcatcgccatgccatacccaatactcctgccaccatgggtcccaaatggtccactgggccgaggttttctccggccggtctgggaccggggagggtgtgaaggagtcgttccggtcatctgctactggattgggcggcggattctcgtccagatctacgatcttacagtggatggtggcctgtgctgatcctgggccggatacatccacatcgatggtcatgtcctgcggctcgtccggtgtagtccagcgtacccaggccaattgggaatctccgtccgggtagtagacattgctgaccgtataggtcgtcccatcaatatggaactgtacagtgaccggatcatccgggtcactttggccaccgctgacctctaccgccgtgatgacctcggtattggttcggtattcatagtcataggtgctgatctccggctcctccggctgctcctcaaagcggacgataccaagcccaagggaggacttgatgtccgagttggacacattcttattggtggggccggaccatgcgggatagcctaaatctggggtttccagaaacatggacaggggaaggtttttggccgtcagcgatcccatccaatagcggagttgtcctccaaccacctcgtcataaagggcggcctctgtcgctgttgtggcaatcatgacaccttggaacttataataggcgatgggttccagcagaattttgtattcgccgctgatgagcgtgtcataatccataccagtttcttccgcaatgaacttgacaacatattctgaacaaaaatactttttgatggcctcgatgttattacgcccgtttgtacttatgatgcgaggcattggttgtacagggtttttatagctatacccgccttgtacgggagagagcccagtaccattattgtactggattttactgacctttccgaaatgatatattcctgcagatggtgttttgttggtcaaatcaaatggtgtagtaacaacggcatggtcacttgcccgcactacggttacacgcaccccttcgtttccggggttccaactgccatgactcgtcgcatcccccatactcccgccgccaccatcaatgttaccagacccgccagttccattcgcggcataaacttgtatgcaagtaaaggaaaatatcatcacaacggccagaaacaggttaaagagtcgtttcacttgatctcctttcccacaaaataaaaagcacagccaaagctgtgctttttgaagatgcgatattactttatcccattatgccaacctgagtattgatatctccatcactatcgatacttccaccttgatttgcgcctgcgttgggaacattatcgaaaccaggcaggccgccactggtgttggtggagggctgttcagggggaggcgtcacattgttgtgatcttgcggctcaggagtaccctcgaccggagtcccatccggcgtcttggtggggtccttcagttcatcctctgtatattccggtttgaccgggtccggctgaatggtctgctctgtgccggtaaaatcagcgccgtttccatcatcggtgttggtactggcatccggggtttccgggttaacggtcacattatctcccggcttctggtcatccccggattctgcgggaggcggggtactgctgtccgggtccaccactacatcgccctgctgggagctgctgggcgggagcaggtcatcggtgaccttgtctttgctgaagctgcttgcgatcacagcaaccaggattgcgcagaccacaagacatccggccacggtcagccacttcttggtattctccgtcatcgtttggattcctcctttttctgttgattatgcttcttgtcaaactgtctgtgtgacttcaggcggccaaggatagttcggctttaagatctgctgcctacattttcctataccgcccgtcctttgtcaacacgaaccctaccacaaacaggcagagaagtctattgggacaatagaaaactttttgaaaactgcgttaaaaccgaggggcatagcccgcgctgaccttgactgtcatccgcatgggcggcagaagctctcctccaaaagacactggaacctccaattcgatttcacagtccgccacaaaacggtcgccggcgctgtcgccggaagcgaacggtgcgttgcggatctccacatcaaggccccacacacggaactccatcccaccatcctctgtgtactgagtatggtagccgccccgataggtcagcccaaggatatcgtccaagcgtccatagatatcgccatagtccagtgattcctcaaaatctcccgccaacggctggtaggcgccggagtagccctcccggacgccatggtacacatcgtcatagttgtcgttgacggtggagatcacagcctcctgcaccgcatcccgaaccccctgggccacgatgagcagacggaaatattcgctgatgcagcacatcagcattaccagcaccagcacaatggcaataatcagggggaaggccacgccgcgccggtctttcaaaatctgcctgagtctgttcatttccagtacacctccgactttcctgtggcatctgcccgcagggtgatggggaaactgccaaagccggcaaagagaccgaggtcgatctcatgagtgagcgtgaccgtgacctcctcgttgagctggatgcggccggtatcgctccattcaatctccgggtccaggccggtctgctcccgcagggcctgttcccggcggtcagtttccggcccgatcctgccggcgatttccgcctcacgcaccagttcagtggcaaaggtatcgagctgctgtttggcaataaaggctgggaggacctgcactgccagcgcgatcaccagcatggcgcagagcaccaggacgcacacatcgatgtatccctctccgcgtcgggatctcaaaatccgtttcagcacatggttacctcctcgcctaaagtcagatccctttcctgacactgagcattatattcgctcaaaatactggagatagagctttccgatgaaagatcagttttatcacttgtcaggaattggtatagtgcttccacaggattttttggcttaaggattaaatccaagtcatcatcgtcgagttcataactgtcatggataagagcagaaagcaggctttcctttgccgcagtttcagctgaatggcgataaatttcatcggcagatagctgcttcaccctttgagcatattccttcatttcatcttccgcacgatcaatcaatcgatagatgctgcctgtatagtccattgggcacctcctctcttaaaacatcccgcccagggaatggataatctcgtagatgatgatggacagataagtcaccaggaagcacatgagcaggacaaaggagaatacacggatcttaggcgggattttcatggcctttgccttgaggcgctggagttccagctgcttcatatcgtggctgagcatctgaaagtagtggaccccgttgtcgcctcgcagcacgccgatgagtccgcggacaatgtccgaaagcagcggagagttgaaccgggcctcaaagcgggtcagcgccgcctcataggagccggaacgcatatccgcggtgaggacatccagttcagcggagaaaacaggaccggaattctgcttataatgctcaatcatgctcagcacatcccggctggcggccagttcttgggtgatggtggccacgaaccggggcagttccgcctcaatctcgtccctcttggcagagagtttttcctccgccctgcgaatctctttgaaataaaccgccaccgccagaagaacaactatcaacgccaacattgggaaaatcaacaggcacggaatcaccgtcagcagcactgcaccggtcttgatcatggcaaaggcggtgtactcctccggtgtcatgttcagcccagcagcggccagcgtatttttcagacggccccgcttatactcatccatatggatgtgtggggccagcttgatcgcccagcccatgagcagggcctccacactgcgggcctgcttcttctcctggcggcccaccgagagcatggcacgctgggtggccagacgggggagcctgagcagatcagccgtcaaaagaaacatacccagcgcaaggaatatgccaaataaaaacagaaggaaagtcatggttgttttgttcacctccacataaaaacagagccagtacacgacagatgtgtaccggccctgtttttcttcttatgctgtattacaaggcactctttctatagcattattgcatcacatctaactccgcaacaaatgacggatcaaagtcatcccgccagtttcgatagtcaggatacagtcccaaaccctttcggatgagctcccggttttccggggtgtcaatatagataccgtccgggatgccgtccatcccatagatgagccggaccccatcctgctccgctgcctttgctgcttcaaaatctccatcatagagcgccatgtcatcgatgcgttctacatggagggcctccggaatataggaaccatggttgatcgttgcggtaataaaatagcccttttcctggttactgatgaggatcacctccgatactcaatgggctgggtcagcttgatgaccgctgcggtgctgatgaacatcacagcggcaatggctgccaacagcgcctgccccagcggggtgtgcatcagaacatcgtaccagtcctgattgagccagtacaacagcgggatattgccgatgaccagcacctgcatggtgataaactccttgcggggctcaaacaccagattctccagctcaccgttgacgatccgcatatcggagagtttagccacgatgggagtcaggatggtcttgagcccccggtcgtgtcggcaggtcagcagagcggccacccactcccgaaacacggcgttgtcgatcttcgtccccatgtcctggagggcggcgtccacatcggggtccaccagcttgatccgggtgagaaactccacaaacacactccggacgggcgggttgagatagtcaatgttttcctccactgccgtctggatgtcctcattgcggagataagctgtggtgatgatagagagggcggtttccagttcagcggcaatgttctttttgtagtgatttgcggtcagacggataaaccagaacggcacgaacatcatgcccaccgccagcaccggcaccaggaagaggttgcccagcgtcagggcgaaggcggcccctaccagaaaaagaagcagggacagggcgcacaccatgggaaacttggcggcccggccagtcatccgcagaatggtctgtgtctcctcgatttcccggcgcagaaaggatttctttttgcgccgtgtactctcattaacctccgaccggatgcttttgggcttactggtgattctgcggaacaccccttcagtgaagtccataggggagatgtgtaaaaggacaaaacaacctgtgatcagccctatacaggcaatcaactggatcagattcatacagattcgcctccttccttgccggtttcaggtttggcaggcggcttggactgtgcgctcctggtcttcggagcgggcgttgcctgtcctgcctttgccggactggagcctgacttacccttagagggagcggactttttgcccacgagctgagtcagcacctcctgcggcataccattgtcgatgaaccgcttctgcaggctttccgagatggggttgaccgcctcgtggcggcccttaatacggtatttgccgtcctccaaccggttttcttcgattttgaagtgataaagggtgttgtaccggcgctccccagtgggcaggatctcacactccatgatctccatgattttacggctcttatcctccagctgcttggcgaacaccacgatggggaatgcctcggtgaccagatccatgagggtatcgtcggccatctcgtgcttacgcttgcagagggtgaccatacgccgccatgtagcctgggatgagttggaatgaatggtggtcaacacgccgtggccagtacgggcggcctcctgtgcggcatacgcctccgcagaccgcatctcgcccacacagatgatgtcggggtggtaccgcagggccatgtccagcagcatatcctgatcgatattctgcttggcgttctcgctctcacgggtgatggtgtggatgacgctgttgcacacccggccatctttctcccgcaccaggtccagctcacgggagccgttctcgatggtgaaaatacgcttgttgtccgggatggtggtcaggagccagcctgccaccgtagtcttgccggaaccggtggccccggcaacgcagacggaaacgccgtaacgcaggcaggcggccagaaagtccagcatggggcctgtggctgttccaccttttacgaagtcctctttctgcatattctgcgggttgacgatacggatggatgccgtgacgcccacatcctcgtccaccaaaggggtcttgaggaccgcgatgcggatgttcttgctgagatggcccaggacggcgggactggcattgtccagcaccataccgctgacatggagcatacggcggatcacattgacggcgtgttcagggctgtcgaaatgttcctccagcttgaccgtttcgccattggcgtacaacacctcgatatcccgccaagagttcacattaatctcctcaatgccggttccgaagatgtacttggtgagcaggccgaactcggccatctccgtgtagagggcgtccaccagctggtcgccggaatagcctttgaccgcgatgcgccggtcctgcacatatttggtgatgtaccgtttgatctgggccttggcgtcttcatcgccgccctcggtgatgagggcggaatacttgccggagatatattcctgcacatcctgcaggacggtgttgaaatcctgcccttcattctccggggtgaagaagagagaatgcgcccgatagccgcctgcagactctgtattcagggaccgcctggggagatcctccgccatgttcacgctatctgtgggatcagcttcaacccctgtcccatcatcagctggggcgtgacgcagcggctcatctgcgggctggggttctccaacgccggcttcatgctgattctgacccatattgccgcttaccgggcagtccgggccgaaatagagggggagttcttttttccgcccgtccggacctgtcgtgatatgtgttgcggcggctttctcagcggacgctttgggagcgaacagggactgacttcgcttctcgcctaacacccaaacacctccctggcaatcttctcgatctccttgcggaatacccggctgtccttcatggataggtccgccagcaggttgccggccagatactgtccctccagctccgccgaatggggcagcgtgaaggccactgtccccagcgcctgactcatgtgatccccggcctgctgggactttacattgctggcggtcttgtactgcttgtccgtatcccatttggcatcccgcaggaggggaagttggctggacaggtagctgatgctcttgaggtcggcgttggccagccgcaggacggaatccgcctccatgagcgccacagcggagaggatgtcgttggcgatgtaactgccgcagtcaatgaccacataaggagcgatctcccgcaggcagtcgatgagctcccgcgcctgcacctcgttgtaaggcgggtaggtgtactcattctctcccttgagcatccccagcatggtgaggtaacccaggcgtttgtgggtgaccaggttgttcttgaccagattctccgacacatgggcggcggccaacacgctcccgagggaacgctcgcactccagatctgccgccgggcagatacagggaagcattggggctgtcatgtcgcagagaaggaggatcacattccggcgcttgtcggccagatacttggccagccgcacggccacggtggtcttgccgctgccggggctgccccacaccgccagcaccccgccgctctgatcctcctgctcacaggcgtcctcctggccacttcctcgggaaaaaatacccgctttcttgaagttcagcatcaggccacctcctcggttttcgcgggcgcctccgtttctgcggtttcgctggagtcagcggcgggttcggactctgcgggattctcctgtggtttctcctcggggtccggctccgggggatacaattccagaatgatctcgtcttgagaggtcaggaacttgtcggcattctcccggtcgccccggtagaccagcgccagatggatggtcccctcggcctccagctcggccaacactttggcctgctcgggggacaccagcagggtgacagtatcgggcagttccttgtcatcctcctcgtccacaggctcaccggtgttggcgtcatagccggaggaggcggtaacactgataatctccacatactgcagctcagcggggacaacggtctggccctgctgcttgtagtccggggcgatcaccgacacaatgtcgccgctctgcagcttgccggagagcccctccgcaaaacttttgatggacacggagatggcctgctggctcccgtccaggctgtacaggtaggcgttttccgctgctggggcgtctgagagtttggaagggatgatatagtcgcccacagccagatccgcagtagcgtatttacccacggcgctctctttctgccgaaggacatcctctgggagattatagccgcccacctccacgatctgaaccatgctctcggtgatctcatcgccggcccggatgggctggactacccgcacgatctcagctttctggctgacgctctggttgaacagcggggtcagaccgaagcagatcagcagggagagcaggatgcagattacaccgaccacggtgcgatttttcaaaaaactcatactggcatttcctccttgatttcatgttgggtcggaaagtccgggcattacgcccggaccgatctggcccttctgctccgcttcaaccggggcagaagaatggcggccgccgtcaggggcagggtcacgccaacgatggtgagcacagtctttctcgttacatggaacttcttcatagcagtcaacctccaaaacagtatagtgcggcaaagccgatggataaaaatggtcccagcggtagcgccgcccgtgtcattgcgggtagcggatgatgaatgaatttttgaaataacatagcggtgcagaaatacagcaccgccagcagcagacccagcgccatcccccagatcccccgccaaaagcccagcacaaagccggccgcagcagtgagtttgatgtcgccgccgcccatgcactccggccggatcagggcggcaatcagcaggggcagagccgccagcactccaaaaaactgggcggggctgaaggagatcagccccgccgcggcggtcaaaagacagaggaaatccgggatagtacgcttgcggcagtccaccgcagaggcagcggccagtgccgtgagaaacaggaacgcctgcaccgggtatcagcccttgtagtcaaacatttcctctacgcgctcggtcacggtgggcaggacggtgtccccgaacagagtgtagaggccagccaggagcagggcgcccagcaccacggcaatcaggatcttgatggcggtgtcgatgtagccctcgccgcgagtgttgcagagaggggcggacaggtgggcacgggcgcaggtcatggcgcagtgggccttgcaggtcatcgtctttacggtgttggacatcttgttgaacatcttcttcatagagagttcctcctcaaaattttagattgttgattgttgtgtggtcagtgggtcacatacccatcttctgagcctgctgtgccgtggggtccggcgcggactggggagagcggttcatcccctgcgtcagtgcctgctggtaggcggtcacgacagccgattccagttcggcgcgtgcctcccgtgtgtacggaaaacagatgtccttgatttcacccttgctgttgatctggccgggcatggatacaaacagcccattgctgccctccatgagcttgacgccccggacggcaaaacagccgttgatgttcagcgatgcggtggcccggcagggaccgtcaaactggatagagtggatacggacatcatactgcatgggaaggacaggagtatcctgctgggaaacctctccctgggggttttcacttgtggtctgcgcttttgccatggtgggttcctccttttctgaatataaaaaataagtggcttttccgctcttgggtcacagggtcatggtcatgcctgattcctgctccggggctttcagttggacggggacgatagctgtgcggtccacatagtagaactcgctgccggaatcgtcgtagagttcgacaaggtctgagatggccagcggctgtccgtcgctgcccagggacctgcgacagaatgcctcccagatcccatccagactgttggtgctgacagtgccgtcaaacactgcctggtaacgggtaaggtcaggtccgccatattcaccactcatgcggtccagcccaatgaagcgcatggcggcgggagctgaggggccgagctgccagatacggcaggatttcagggctggcccgttgtctgctgccttctggtatccaccgctggagagacggtcatagatgccgtcctcccaccggacagccagccccttccttgccagccagtcctccaactcctcacggcggaacatggagtccgccaccactccttgttctgtcctgtagcccactggattcccatagtagagcagacatcgatttttcatttccacacttcgcatggcggcatatctcctttctgcggttaagtcatttccatccctcccatgcctgcgttctgcccttgaaactcctccagcttttctctggcccagccggggaggaattcctctttcagaacgccggtgaagtctgtgcggttccatctggtctgctctccatcgcccaggcaggtacagcggatagaccgaccgacagcgtgggggctgcatccaaagccgtcatgggccagccagagctggttctggggcgtccagcaggactccttgagggtgtctggactgagcaccaacacccggccctcatagtccagagattcataggagttgggttcgcagtgctccggcccaaatagttccagcttgccgtatgcctccctcacttgactgataaatgcgtccagatacgccagggcggtgtccacttcaaaataacggttatgggcatcatcgggtgggacataggctttcttttgccattcttggttttccgcgctgagctgctccttgtaaggccccagcctttctatcgtgttggccaggacgaaattggtccgcttgaagccccaccgtttcagcaccatttgggatgcttccggctttaatgcgctgcggccgtcgccatagacgcggatgacggcttcgatgtcccgcgcacaggatacattggcgtggaaacttgcatcccagagcgcagcttccccaagtctgtgggcctctgactgtgagccgggatagaggtagatatcctgttccatcttgcctcctttacggcaggcgccatttgcccgctggggggatcgtcagcgggctgatgcccagctcattgagcaggcagcaaagctccaccgaaagctcccgcagttcctccgttgaggggacgatgatgagcgctccatccgcggccagaaccgcgacttcttctcccacggggatagatgcctcggataacagtgcggcgggcagattgagttccataccgctgctggtgtatccggtacactcagcgtcgtcacaggttctggtcaccaggagtctgtttgcgtcacagtcgcagatgtactggttcgctggggtggtgatgggaacttcttcccccggctcatagcccattccgcgcatgaaaaatgcaggcagggtcagagacccgtctacaccgacccgaaccgttgtatggatcttactcatcgccgtgttcctcctgcccattgcatgcggtgcgttctccgtagatgagattccccaccatcagctgttcctccagctcgcccaggcagattccggcttcacccagcatctccagcaggtagggaggcacatcccgcaggtcatggtcatatccggcctcggcaatggtgacggtcttttcttcgtcatccacatagacacagagcttggccccggcagggatgccggcttcttcccgcaggtagtctggcagttccagcatgccgtcctccagatcatcgaatgggcagccatcctcgcagtcatcacaggtgccacagactctggccagatggacggtgagctccgtggccagccggtgcagggcatccatcgcctggatcagttccatggtggtcatttgctttttcagaacgaccaccgcgctgtccagcgtgtggatctcgaccttttctccgccctcaaagccactgatcttgaacgctccgccgggaatcaaaagagtaccattgtttatctgtttgttgaatttcatcttcttctccttattacattgaaattgtagaacgggctggattggatgctcccggccattcctgtccttgttgggcagccagcccgtcccggaaggctgtcagatcttctcctgtcggcgtatagcgtcttgcttcaagggcggccatcagcgcataggtctggccaacctcggacagcagtgcccgaagatcgtccgcaaccatatccgtccccatccggcggagctgcacggtaaaggtgattcggtaatgcggctggccggggatgctgtcgatccgcatatccattcccaagttggaatcgtgttgcgggcggatatagacctgacccactacgctggggcagacctgaaggcggccctgactcatttcctcaatcagctgagccgcctgctggagcttttccagttcagagagctgttcatccaattgcctcacccccgttccagtcaaacagcgtcatttgagagggaaccgcccggctccgctcccgcaggtcatagttggcgataagcagttccgggaactgagccccattgtcgtacctctgcttgatgttgttgatacgggtggtttccatgaggtagatgcctggcctgtcgtacagcccgcggacaaaggcgtcgtcgttgtaggagagcaggaatttgccctcgatccgcatcagggcgtcccgcaggcggatgtggtcggcttcggtgaaaccgtcttcaccaatgttctggtaatacccctcggtggcatggtagggcgggtcgagatagaaaaagctcactggccggtcatattgatggagcagtttttcaaagtccttgttctcaataaccaccttggcaagcctccggtgggcctgctcgatgagcgaaaagttgctacgcatatcgtggggctggctgccaaaactggtcagcccggaggcgtagctgtagcggatgagctgatagaaccatgccgcccgttggacatcgctggcggggctgtcccgcgccaaggcggagcggatgcggtcaaagtcctcccgtgcgttgagtacataccgcagagcctccatcagttcctccggtttgtcccgcacacagcggtacaggttgaccaacaggccgttgaagtcattgtagacctcaaagtcgttgccgggaggcttgtggaacagtacccagcccccgccgccgaacacctcaatgtaccgctcatagtagagggggaacagccggacgatcaactcccgcagggccttcttgcctccaatccaggacatgaaactgttcagggcgtatcacccccatccagcggcaggcgggtctgtgcggtatcctctcgctccagagtccgatccagtccccggatggcggccgcgattccgctgatccgcctggtcagatgggcgatggtggcccgcacctcctggtccgtggcggcatagaagtatccactcccgttgctggcgatggggacgccatcccgccgcagggcattgaccatgtgtcgaacctgaatccctttgatgccgaaggtcagttccaactcccggctggtggcggcgttgagagctcccatgtggtactgctccagatattccgccagccgttctttctccatgaatgcctcctttccgggcctgttttccgaaaaagggcataaaaagaaggggccgttttcccctttcggaaaacggcccctgtgtcatattctatatcctgtttttacttcatcgaatcacccccagctcccgcagcggacagatgcggtttttgtgacttggcaatagatcggctatattgacagagcgggactgtggtgctcaggctggctatactcataccggcgctctccaccgttccaggctacatagccgtggtcggtggtcgagaggccatattgacccatattggcctctgcgtaggcagccccgtcaaaggcgtctgttatcagtctgttgggcgggatcacgccgtttcggaccgcaagttcccgcccgtatgcggccaagtccatgccgcgggggaagaactcatagtgctggagattctgggcgagatccagagccaaatccagccggtggcagtcctccagctccagcaccgcctgccatttgtccaaccagtggggtgccccctgaccctgttccgcccaaacataaccgaagtcaatggcatggcgaaccagttcgctggctgagtcgtactggtcgagaatacccgtcagctggggcaggcagcagtccacctccagcgcgatgcactcgctgaggctctctgcctgtagcgagtccagccccagcaggagttcgtccggatggtttgagtcgatatactcgccggaatccgggaagccaacccaaatcccctccatattgctccggctggccagtttaactcgtatggcatagtcaccggcgaccggctggagggtgggatcttcctctacgaagggatctgccagtttgatgttccgcacatagtgaccgttacaaaaggctccattctgcgactggtggtaggcggcccccaaatgctccgcattcaggaatggacgggcggcatccgaggaacactctatgctctccatgacaaattttccaagcgcggcctcgtctcccgcgccatagaagaggtcgtaacagtccagttgggacgcaatccgcatcacatggccgatctcttggggcttctccaactccatcgccccttggaacaggatcttttctttctctgtcatattggaaaagcgccgctccagccagtcatgctccgattttgtaacatagaagccgtccagcttgtcaaagagggcggcgttttgatctgacatcgctcacatcatctccagtccttgtcctatttcctgttccggctgaaataccgggagaggctggccgtcctttctgcggatcagaccatactctgtgataacccccagccggtcatccagcatcttctggccgatctgggccgcctgcggggtctggaacagctcctctggtaaagcagaatacttctcacggaacatcatctccgcatagccccaggtctgcgctacctcgggacggagttcgtactggtcaatctcgcccatcaaccgtgtggcgtcctgcagactggggtggtcaaccacggataaaagcgccttatacttgaccatatccgattcgggccactcccgttctatttgagccaaccgcttggcaaattcgtcggcctgttcaatgccatcctcatcgtcgatagcgttgttgatagcatctcgcaggaaggggatcaggcaatccacacagcggaatgcacattcatccactgaggcggcatctactttttccaccgctctccatataccggcatccgctgcgggaagattcagcactgcggttttgtcgttatcatagcttgggtcattgaaaaatcccttacgcacctccagcatcaccggagcatcggagcgatggaagcaagccgtttcattggactggcacacatagatgtccttgatttctccacccagttccgcatagccgaagtcggtgaacacgccgccatgatcctcctgatgctgttctcccaacagttccagcagtctttcttgaaagccgctgccctcctctgtggtgtcaagcagagccatagcctcatttgagagcatttcatttgcgtataaaaacgcccccagttcttcatgattggaaactcggggcgcaaaacagcagatatcggtattgtaggtcaggttaatcaattggttcagcggaatgggagcgacgcggtgattctgcttgattttcaaaagagcatccatcccttttttctgctcctctgtcagtgaggccaatcgctgggcaaacaggtttaggtcgtatagattagcattccacccaatcatggcatgcgtgaggccattgtaatggatgcaggttagctcatttttgcagaagctaccgtctttgattctcgccttttggagtgcgtcgctgaactccgcaaaggatgctggcattttcattaccgtggccgtctcataagatttaggtccactgttgctgatctccacctcgaaaattgtcttatctaagagtaatccctccctgtgtagactcttgctcaggagcctcgggcggttccatgtctgagtgaacttcgtttacggtttccaatatggattccaagtctcttttccgagaaatattcgcaaaatccacggagcggcagtatacttcgccatcctttcccacagagcactgtgtctgctctttgcctcgcatctttttcgatttcactgccaggcatccgtcatcggcaattcgtgaggagaagcccttttcctttaaccgctccgacaataccgaaaaaaactgccgcgttctcccatcaagatccattttatacgcctctttctataaactcattccctgcatctcaatatcttctgcaggagcggaaggggcctcatagagtgtgcttcggccataagcgatgcggatgatatcctctgcggagtagtcggagccagcgccaaaaagatgcctgaactgcaggcggtctgacggagcaatgtaccatgtggaatactgagacttcagccctttcagggattcagccgatgttttgaaggtcagttccactccgtccttctgtaccgtgacattgaccgtctttgcgccacttttttggagggcatctgtaatcgcccgcatccgatagaccggtgcatcgctgtcctggctgagcatctgatactctgccagcaacgcatccttctttagaaactgcgccagaaattcctcctggttgtcccgcatgtactgttccgcagttgtttttatataatcctccggggatttgaggtaggagagcagggtgtcttctgtcaaggatgtataatactcactgtgaaactgtacatcgggtttctccccagaaaaaacgagggaagctgcctcccgccctgcctcggttcccttgtaataccggtatgaattgatgttcctctcactggtgagttccctgacagagaggcgacttcgctcattggaaatggccgcctcaacatagcggtcgacctcctgagcgatgcgcttcccaaacgccgtagaatcctggcattcttcttccgtcagtccggagacaaagttgggaagggggtcatccagaagatggagcgcctggtgttgccggtcgtacaggccgcagaactccaaacggtcgctccagctgatcctctctccataaaatgtttcgcatccaaagaggtaatcaatctctggcgttgcgggaactttcactactgagcccaaatgcttgcccttttgcagaactaaaactggcacagcggcattttccagccactcttgaaactcctgccggggaagtggggcctgcttttgctgcgacattacaaaatcctcccattttactgtttctgctcaaagtttgcacaacttgtctgtcccgagtatgactcttcatagtgtttggggtcagcaccaggcacatcccacccagccatgcttcctatctccatagcttgccgctggatgggggtgacgcccaggtcttcgttcaactcatccgccagttccacattcccttccttgtcgccggtatcccagtcggaggggtagtagccagtttcaccccgtttgatgcagataagctgtccggtggtccgcagggtggagaagcacagttccggcaacccctcggccaccttgggggcaaaccgttcctgttcggtttggatgctccaatcatcaggctgccacagatggacatacagctcgccgccgtccacctcgatggggcgctgctcgaagccttcgccccatccgtcagaggcttgtccacccaggtactcttttaagatggtaagctcttccggagtcagctctccggccacccggcactccgctacgccccagagctggcgattcctgacctcaacagtaaacaccgccgagcggaccttgtgatctacactgtcgtcctcaccgtaccagcgcatgaggccgctctcgttttcctctggtacccggttttttaccagagcggacagaatttgtccctcataatccatgagggtgtggccatcccactcctcaccgtcctctgacatatccccccactcgtcccgtccatagaagtccgctgtgagcggcatatacaatttgaatgtctgaggctctggcagatagaccgagaatcggtcttctcccagcaccagagccaaggtacatccattgtcccactttacatggaattgcccggcatcgtcgatataatccagtttcccggtactgccgggggaaatgggccggggattaccgcctatctctgtgagttggatgcgggaatccttggggaactgctgccgcaagaagtccagccactctctcggtacgctttgcatttacatctctcccattctaatcccaatatccggctgatttaattgttgatagagccgttccatcgcctccgccaccacgaggtccgaccggaagctttccagtttttcgtgatccgtaaagaattgctgttcaccgctctggaaatgaacaaagtccactgtggcgataccgtccttaataacgcccagccgtttctcactggtattgctgtcctggtagatttggattgcttcctccagagtcagatcttgcctgattatctcctgcggggtattggtgtccgccatgacaaaccaggcataggtgtggggaatgctgggatctgcggctttcctaagagcctgcttcccagtttcagtcagtccatagttgcaggtacagcgtgaattgtcctcaccggcaaaatccaacaggatatcgtctaccgcttttttgacctccggatcgtctgtcagcgtttcaaagcggaagccggttgtgctgcggaagggcagttcctcccggatggcctggagcaacgccttggaatccgtgaactcctgctgttcgccgctggcgaaggttacccgacctaccacagggtgttcctgtcggtacatctcctgctggcaaagatcatagcaatagaggtacccctgatactcgccgggaaagggagtacagcgtagacagaaacggtaattttctgtttccgcaatatagccataactcctgcggtcctctgtgatggagccgccatgctgccagcagtaggcgtccatggcccccagattcttcaggagtccagtctgacgcaggtcgtccacaaatcgctgcagcacctctttgaactccggggtgttgaacctatcctcgttatggggccaccaggtgtgccagaactccttctcaccatggccgaaatccatgcggaggtggcctacagtacccagtgcctcgtccagcttttcttcggaatagaacagccccacctcatccagggaggcggggcgcagtacaaactcacgattatcctgggggtaggccagatcatgctcctcgcaaaactgctccagcgtcatttcttctcccagcagataaaatgtgccgttgacccggcgcgaagcagtaccttcatgctttaaagggattggagaaagtacggttcctgcatgatagtcagcggcatgatccaccagagtggttcgggtgctgggagatttatgtgtcccccgcaggtcatagcagtaccacccatcaggaatgatatcccgctgaatcagccagttggtgaacagcacaggttttccaagcaacgctgcgtgttgcatggagtctgtccagatgttaatgctcatttaatccctcccatattcacagtgttttcccactcgtgctggttccacagcgtatcttgtatctgcgtacagggattaatgcatctgcaacccatcttgtacttcagggaacggatcactgagctttcggagcaggccaaattcggtccttctcacaccatcctcccgcatataaaagttgcccattgcttcgaaatccgtaaagccatcgagggtagagatcagctcctcgtccgccccgatccgctccaacacctgcttgccatattcctccggatcgtccggtacacgctcgtagtcatccagttcgatggaaaacctcaaagcctcctggagcgttgccggctgttccacctcaaggacagagaggtatttcagcaatgcgccatcctcctgatccattatccggatattttccgccaactcgtccaattgctccagtctcagatccatcccctggagaggaagatattcccccagataaggccgcagggcctccacccgagtgagtttcgccatattgaggctgtccactcccagaagttgtctggcgctctccaattgctcaaaggtcgcaggcagagtgatctgcgctgtttcgctctgtacacgaacagggcaggggttttccatccatatccggaaaacgccgtccaatctctcgttctccaaaagttcaggtgtctttttctgcacataattgccgctggaatattctcctccatgcttttcccgatattcagcccccacacgggcataattgatatagggcttgaagcgatccggaaatggtgtgatccctttgttcacaaggtagatgcccaattctgaatcagacgacacattgttgacgagcatatactcatccagcctgtccgccacagtaagggccccctccaagttccagacacactccgcatccaatgccccggaaaagatggcggctttcgccggagaaagtgcctctgtgcgttccgccagtttttgtagtttttgaaactgctccgaatcttctacatccacatcgtacaggcatcggtaaaggaccggtacattgctgctcacatccaggatggcggtggctgtggtatcgaggctgattctgtccaggaaggcaaatgtctccccaatctcagcgggactggcgggcagttgcagacggacagtttcttctccttttccccggctcagagtcaacagaatcatcgttacattcctcccatctgaaattcctgttcccgctggtgctgctctgccggaccgccggccatcagctcccccaatgtcaatgtgccacagtaggccacatatcctttctccgtgaaggctcctgtttccttctccatacggagtttgccgtaacgctcataatcatagaactcctccagattggggtcatattcataatggccggagtcctggatcatgtatctgccatattcggcgggagtgcggactttgggtgcaaactcaaacagctccagatttttggccagttcgcgtatctcgccggcacactccggcttggccatctccatgaccgccgtcaactttttctgttccaaatcagacagtgcagcgatggccgtcgccatatcattcagcgcgaatagatcctcccgttgtccctccaggacctcctccacctcggatggaagcagactgtcctcataccagatgcgggcatcgtggatgttaacgcctgagcgtgcaattccacgctggagctgttgctcggagcagggcaggagcagccaagtgatttgatctgtattttccggctcctgccgggaggaaagccctaccgccagcagattcggctggtagtggtaacaggggaagtggcggccgtcatagagctgctccagtttcatcccgttatcatagaccacgccataaggggtaatccttccctcaagatgattgaggatcaggtccagagcgaacttgcggccatccagccgctcgagctcctcgattctgcagcccccaccctgcatcgtcatgtagtgctgccgcccaatggcgtccaggtcggagaagtctgtgatgaccgtggcctgctggcagcaaaaggtcagattgatgaaatcctttatatttgagacgcccaatttgcaggccattccctggaactgggcagcctcaccgtcatcaaaactgtccagccgtttggccagatagtccagctcatcaaaattgaccaatgagccaaccagcctgttcagtacggtatagaagctgtccagttcatccacccggcaatcctgccggagcgcgtcaccgatttccaatggctccagcagttcgatcatgcggtcatatttctcatcggggatagggaatggaaccgtaatctgcccatattccgggtgctgagcgctgctcagtaccgctttcagcacatagcccattctggtgcctccttactcgcatccatgaccgcctttccatatctggcaatcatggttgcgtaaataatattgtggaagtccagatcactcaccagttttgggtgtgccaaatcttctgcctccatgggtgacttcaggtcatacagccgtctggcggaataaaagatggggtaatcctgtatcgcaaatccatggggtttggatacgatgcggctgaaatcaatggaatcgtgtgaaagagcggggagcgccggttgccagagtcgctcctttgaggcgagaagatagagcgccgccagatagccaggaggcgcatcatcccataccctgtccgcaaagcggcttctgaggtggacggacactgtgtgcaggactgcctgatccggcccgctccagtgttccacagcctgaatcctcttgtgcaggccggcatgagggatgtgtccgaaatattccagaatcaaatccaggtactcaatcgcgccggacttcaaccgctccgcgatatacggacaggtgcggacttgacaggatcggcggcggtaatgcaggcagtaccggcaatccacatcctccggcttgtagcagaagcggctgaggatcatcatcccgccgccgcgcttctggaagccagggacgctcatcatcatatgctccagaccagctcgaggggtattctgagcgaaatatcttgtcatggcacactccttctttcaaaacaaaaaagcgggagctgcttatgctgcacagtgtgtgcagatgcggctcccgctttttctgatgtcacatatcaatttgtggctcctgtgcttgtccctgctccagtctgtccgccagatctgggacagtgtattcgatctttgtccttgcggtctgcatggctttgaggtgtccatcttccagctctgggccttcatccagcaggtagtctgtggcccggtagagttcagttagctcctccggtgagaaaagctgggtcttggagatcagcccggagcggacggcaaaatcctgcttggccccgcaaaaatcttcatcataataatgtccgtagctcacgccggttctgttatagtcccagatccaagtgacaaactgatagcccctgccattttccaactcccggccagccagcactgcgccgccaaaatccgccagcagatggaatttttcgctcagaccgctgatatgaagggtgggcgcagtttgaacctcctcaacataagtgtacacttcatctgcggtctgtgcgactctgtggtacaattcactggcctccggattattgcttccggcaggaaaaaggaacacatcgtttcctggagaaacaaagaggacaggctgaccatggaggaaaatctccagccgcctatcctctacattggatgattcaactccgccttctctcaggcgccgggaaagttcttcaaaaaattttttcaatggttaaacctcatttcttttttatctgttgggacgacaacaaaaaagcggagattctatcatcgaatctccgcttcaataactatattggtttttctccgggggaagggaatcaggtgtccgtcctctttgtgttttcgtatggatagaacaatgactcacacatttggtctgtgtgagtcattgtttttggtggagataagcgggatcgaaccgctgacctcttgaatgccattcaagcgctctcccagctgagctatacccccatgttgccagaaacccttgattttgctggatttctgagctattcaattttttgactttactctccgttgcgggggagcacacccggttgcttgcgctcccaggtgagctacgcccccatatggtgacccatcggagattcgaactccggacaccttgattaaaagtcaagtgctctgccaactgagctaatgggtcgcccccggcagtcgaccagcacgttgtctgtacgacgcttaattattatagcaggggaatataagcttgtcaactatttccggggaattttttaggaatttttgcagcatacacagaaaccccgataaaatcgatgtttgaacgcttggaaattggcgacatccgtccatggagacaggcgtgagcagaagggtggtacgaattagaggctgtttaaaaaattaaaatttccgtttttttcataaacggcggtgaatattgcgataaaatgcttcggaatccgaaaagattcccgctgtttacgaaaaattctgtaaattctctatttttgaacaagccctaaatagctgattaaatttccaaagcgtggggtgacaaaatatagcagatgcggtaaaatggatttattcggagagggggaacagccagatggaagaagccggagcgatatccgtagcaacgctgcgcggcgttggagagcagcgcgcccaagcgctcgcgaggcttggaattgtgacagtagaggatttgctgctgcattatccgcgcggctatatcgacctgacagccccgtgtgaggtaatgagcgcgccattggatcaggtctgtgcggtgcgtgccacagttataaaaaagggacgtgaaacacgtctgcgcggtggattgcgtctatataaagtgatagccgcggatgactccggcgtactggaactgacctttttcaatacgaagtttacggttgacgccttaaaaatagatgagccatatttgttttatgggaggatggagggaacgcttctgcgccgtgagatgcgcgcgcctgccgtttatccggagcgggctgatcagccgtttatcgcagtctatccattgactgaaggattgacgcaaaaagcatttgccaaccttgtcgagcaggcgcttgcgcgcgctcccggactgccggaacggattccagagacagtacgcgcaggcaacggtctggaagggattggacaagcagtgcgcgatattcatcgtccaagcgacgcggcagccctggagagagccaagcggcgattgatttttgaagaattatttatgctcgcggctggcgtgggattgctgcgcacacgtgcgcgcacggaacaggccgcgccgatgcagccgcattcgctgaaggcgttttatacggcgttgccttttgaactgacaggggcgcagcgccgtgcaatcgctgatctgacggacgatctgcaaaaaccgactccagccaaccgattggtgcagggcgacgtcggctcgggcaagacaatggtcgcggcggcaggcgcgtactttgcatttctgtcgggcgcacagtcagctatgatggcacccactgaactgttggcacgtcagcattatgagggcctgaaaccgctttgtgaaaagctgggaatgaaaacagcccttttgatcggatcattgacgccggcgcagaagcgtgctgtatacaatgcgctggaaactggagaaatcgacttgtgctttggcacgcacgcactgatttctcagggagtccattttatgaaccttggccttgtaatcacagacgagcagcaccgctttggagtggcgcagcgtgccaagctgcgccgcaagggacgctgcgcgcatacgcttgtgatgtctgcgacgccgatcccgcgcacgctggccctgatgatttacggggagctggatatttcagtaatcgacgaacttccgccgggacgcagcccggttctgacatataagatcagctctggcaaacgggaacgggcgtttggatttattcgaaagcatcttgaccgtggcttacaggcttatattgtatgcccgcgcgttgaagccggggaggaggatatgggcctgcacgcggccacggaatatatgatggatttgtcgagcggtgcgtttaccggatatacagtcggcctgctgcatggacggatgaaggcgtctgaaaaggaacgtgttatggagtcgttccagcgcggtgaaatccagcttcttgtctcaacaacagtcgtggaggtgggcgttgatgtgccgaacgcggtcattatgatgatcgaaaacgcggagcgtttcggattaagccagctccaccaactgcgcggccgtgtagggcgtggaaaggagcagtcttattgtatcctgctgtctgacagccgcagcgaggagacggtcgagcggctgaaaataatgtgcaaaacctcggacggctttgcgatcgctgaatacgatttgaaaacacgcgggccgggcaattttctggggcaggagcagcatggcctgccgcgcctgcgcatcgcggaccttgtcacagacgcggacaccgttacgcaggcgcgggagtccgctgagtatatactcgccgctgatccgacgctttgcgcgccggaacatgccgcgctgcgcgcggctgtcgagcgcatgatggattcagtcggcggacgcccaaattgatcagaaaagggccgtcacacaaaagcgcgcttttgtgtgacggcccttttttcaggcttcgccatggtttcattgcacggcaggcaaaactttttttttacactgcgccagaccttctgtttgcggcgcagccaattaaagtttttcgccgaagccttttttcaaaaaggctggaaagtttttcgccgaagccttttttcaaaaaggctggaaagtttttcgccgaagccttttttttaaaaaggctggaaggcaggaatgtctcaggcgtgcttggagcggtaaatatcgtaagcgtcgcgcgcgatcataagctcctcgttggtcggaatgacccagattttcacacggctgtccggagcggacaggtcggtttcagcgccggtgcagacagcgtttttcgcctcgtcaagcttgatgccaaagaaatccatgttcttgcagacgcccgcgcgcacgtcggcggaatgctcgccgatgccgccggtaaatatcagcgcgtcgataccgttcattgcagccgtataggagccgatgaatttctgaatctgatagttgcgcatctccagagcaagcgcggcgcgttcattgccgctgttcgcggcctcctggatgtcgcggtcgtcactcgatacgccggagacgccaagcataccggattttttgttgatgatgttatgtacttcgtcaagcgtcaaattctccttgcgagcgattggctggagaagcgacggatcgatgtcaccggtgcgcgtacccatcatcaggccggccagcgccgtgtaccccatcgacgtatcaaccgatttgccgccgtcgatcgcacagatcgacgagccgttgccgagatggcaggtgacaattttcagctcctccggctttttgccaagcagcttggccaggcgcagcgaaacatagcgatggctggtgccgtgataaccaaagcggcgcatcccatacttttcgtagtattcataggggatggcgtacatataagcttttttcggcatggtcaaatggaaggagttgtcgtaaacagcgacctgcaccttgccggcgaaggtctgctcgcacgcatgcacgcctgtcaccatcgccggcagatgcagcggaaacatgtcgcgcgtcgattcaatgtccttcataacctcaggtgtgatctcgttggacatggacagactcagagccagacgatgtccaacggcaacgatgtcgtccatgctttcgataaccttagtttcaccgttcataagcagctcaaccacgtgatcgagcgcatccttatgtgtgggcagatcgatattgatcacctttttttggccgtccccatatttgtaggtgatgataccgccggcaataccgatgcgctcgcagttgcccgatgcgaccacgctttcattttccatattgatgagctggtatttgagggtcgagctgcctgcattgactacgaatacattatccatcccatatggctccttttctttcagatattttacaaaatgttttctataaagaaaaaattaccaactgtatgtatccggcgtactaaacgcgccggatgatgcccattggtgtctgttcgctgcactggccgagcgggttgtccttgaggattttgcagagcagttcgcggtccatccgtttgtcggaggtgcccaggatctgcccctccagatcgttgatatcggtgacggcgacctgcgtaccgcccaaccgctgagaaatatcggacgcaacaccgtcgggacggtcggggccgagcacaacatagtggttatagggcggcagtgtgaattcacacggaccgtcaatgctgcgcgcgcgatatccggcgatgttgtaaaaccagccccggatgccgaacagctttccgacagccgagacggcggcggcaaacagaatacggatggtgccgcattcacgcagagcgcattccattgtttccggcatggccagcccgataccgtatggcgtgcgcagaacaaatttgcttaaaaaccgcgcgagcgggcgcggatggatatcctccaggggaatggcgcggcgctgcgtacaggcgaccgccttctctgtgatgaatacaatgtcaccatcctgcacaagcggagcagcgtatttttccacaacatcaacaatattatccttgtcggtgatgacgtgcgttttgatgcacaggcggcggtactggacgccgtcaacctcgatggtttcattcttttccggattgacgacatacccttcggagctttcagactgctgcgcagcatccagtgcggcgttttcctgtgcgtccggctttgcggcagctgtatcggctgtgggcgccgccggtgtttcgtttacggcttgtacgtcgtttgtttcgttcggcatgttttacaatccctacctttataaacttcgtcgatgagacatgttgatcaaaatggattcaggccgttttttgagcggtcttttctattgtgcaatctcactccaaaattatacaactttttacctctgccgtcaaagggaaatacgcgccgcgcggcctgttcaggcggctgcttcggacgcgcctgcacggtcgcgccggatgcaccaggctgtgatggtcacgatgacgaccgcgccgccgatgagcgcgaacagaccgggacgctcccctgtaaagagaaagacccatacagggtttaaaagcggctcgagcgcgccgatcagcgagcagacgagcggcgggcagttcttgacagcgatgccgtagagcacataggggataccaagctgaacgacgccgagcgcaaaaatgctcagaactgctgacgcagatataggcgtatcaaagagaagcatacagggcacgccggcagccgccgtgaacaaatggccgatcaggatcccgctcatacggctttcctcgtcggcgcggcccgtggcgatatacatgaccgccatggaaagacccgcgccgatggcgacgaagttgccaagcaggttgccgggcgagagctggtcaaggaaaaacagcgcaataccacacatggtaagcagcacagcggcaacatcggcgcgggcgaaccgctggcgaaacacgagcgccgacaaaatgaggataaacaccggcgcggtgaattgaagcacaatcgcattggcggcggtggtcagcttgttggcggagacgaacgccaagaaggtcagcgcgagaaaaacgccgcacacaagcgacgtacggttcacacgcacgcgcagccgggccgcgcgcatatacacaacgacacaccccgctgaaatcaagctgcgccatccggcgatgaccagcgcgttccaggggatcagcttgataaaaataccggcgatgctccatagcgtggagcagatgaccatcaaaaggatagctcgtttttgggcggcttgctgcaaggatactcactccgtctttggcaatcttttggtatggcggcgctatgccgggatagcatttcatatagtaacgcaaaaaagcaaaaattacaagcccggcgcgggaaaataggctttattctgcgggaaaaaagtgtataataaaacatatgtgatcaagggccgggctgaagggagggcaagccccttccgcttggaacgggcttcatggccgggcgacagcccgcctgcaaaaatttgccttgatcgggtccaaaatccctcgcctgtccagcatactccggctgtgaatacaggttcttatttgaaaaccggaaatgttcaatcatagaaagaaacggcgttttcaattttcaagcagccgctaatattgtattttgaggagcgcctgatggtattcgcaaatttactgtttatttacctgtttttgccactcaacctgatcttttatttcctctcaaagcggattgtctatcgcaatctggttttggtggccttttcctttgtcttttacgcctggggggagcctgtctggtttatgctgctgctgacgtcggcggcgtttgactatatgcacggacggctgatcggccgtttccgcgggacatggatggccaaggcggctgtggtgtcgtcgctggcgctgaacctgtcgctgctcggcagctttaaatacagcggattcattgtgcagactgtcaatgacctgttgggcacgtcctttggcgtgccagccttcgcgctgccaatcggcatctccttttatacttttcagacgatttcctatgtggttgacgtttaccgcggcgataccgaagcgcagtccaacccggtttactatctgttatatttatcgatgtatcaccagcttgtagcgggtccggttgtgcgttacgccgatgttgcgcgcgaaatccgcagccgcaccgtggatgcagccagcttttcggagggattgacgcgttttgtgttcgggcttgcaaagaaagtgctcgttgccaacgcggccggcagcctcgccgacacctatatggcgactgcgccggcgaacctttctgtcggggccgcgtggtttggagcggcgctctttacattgcagatttattatgatttttcaggctattccgatatggccatcggccttggccgcatgttcggctttcactataaggaaaacttcaactatccatatatcgcgcgttccgcgaccgaattctggcggcgctggcacatctctctgtcaagcttctttcgcgactatgtctacatcccgctcggcggaaaccgaaaccatccctaccgcaatctgtttgttgtatggtttctaaccgggctgtggcacggcgcttcctggaattttattctttgggggctgttttatggggtgttcatcatgctggagcgcgcttttcttggggaatggctgaggcgtattccggcagcgtttggccatgcgtacctgctgcttctgacgcttatcggctgggtcatcttttattttaccgatctcggtcagctcggcggatatctgcgggccatgtttgggctggccgggaaccgcttgtgggacagcggcgtgcagatcacactgcttaataacatcttttggttcctgctggccgcggtgttctgtattcccattgtcaggtggctgcgccggtttgtctgcgaccgcctgtctccagcgaaggccgccgtgctgtttggacttcaaccacttttgaatctgaccctgctgctggtcagtacagcgcagttggtcggccaaagctacaatcctttcttgtactaccgtttctgatcgatcgccctggaggagcctgaaatgaaatacaatccgtataaattatcaaagcatggccggtatcaataccgatacagccctgtaaacaagccggagacgctgcgtactcccgatcccggagaggagcgggcggattattatgaacgcctgcggcgaaaattcacaccggagcagcttcggcgtctcggctggaccaatatcgctgtgatcggctgcgcgctggccttattttttctcgcctcgctgtttgtggaaaagcccgttcgttctgtgattgaaaagcgtgacctcgcgcgtttcccggctgtttcgtccaaggcgcttttttcgggttccttgacgcgcgatgtggaaacctggtatgccgacacgttccctctgcgcgatgcgtttgtcggtttgtcggctgttgtggacgaagcgcacggcgtgcgctttgacgacgtgcgcatcgttgccccgtccggcggtgagacgcaggatatcccgcccgacgcttcgaccaacaccccggttcagccggcgcagccgcgcgccggacaacagaacgcggccgtttccagcgaggacgcttcgtccggtcaggatgagcaggcggagccgtttgtgccgcaggtcgacccggatcacgatcatgcggtgatcgacgacggcatgggaccgggtgcgatcaacaacggcacgtttgtgtataaagggatggctatgtcgctgttcgggggcctgcgtgaaaacggcgcatggtacgccgagacaatcaaccgctatcaagatgagctgcctggcgtgcgcatttacgatatggtgatcccgacggcaatcgaattttatgtgccggacaaataccgcgatttgacgcagtcgcaaaaggagatgatcgattatatctatagccggctcgatccaaagatcaagcgggtggatgcatattcacagcttcaaaagcattctgatgagtatatttatttccgtacggaccatcattggacagggcttggcgcgtattatgcatatgtcgctttctgtgagcaggccggcatcatgccgctgcaaatcagcgactttgagacgcggcgtctcgatgatttcataggaaccatgtacgcgcagacacaggatacgaccttgctcaagcatccggactacgtcgattactatattttcgaccagccctatacagccgagcggtatgaccgcggcgcaccgtatacgccggttgactggacgctttggggcgaatatgcaaaaagcccgaacagctattccgtgttcctgcacggcgattttccgcttgtcaaggtgaaaacaggcatcggcaacggccgcaggattatggtcgtcaaggaatcatttggcaatgcgttcgcaccgtttctgatcaatcattatgacgaagtgtatattgtcgatcagcgttattttgagcttggcgcaattgattttatcaagcaaaacggcatcaatgagctgatctttgcaaacaattcgttcgcggcctgcacgccgtatcatattcagtgtatcgataacatgcgccatcaagctatttatgacgcgccgcctgcacagacgccgtctgaggaagtcctgccggagacgccgtccgggtccatgccggaagtgcaggagcctcagacgccggagtactcctctgtgccggaggaaccggagcaatcctctgccccgcagacgcccccggctgtgccggaggcgccgtacatacctccgcagacatatgtgccgccgcaggagccgtctgcatccgaaccggaggcggattcgcaggaggacgagctgtatgagcaaatggatgatatcgagcggtcgcgccgcctgcgcgcccgaaacgaaaaataaggggaatacgatgagacgtctgcaacgcatgctgaccggtatgctatgcgcagcgcagctttgcggctgcgcttccgcgcccgtacagccgtcgggtcctggacagacaacacagacgctgcgcttcatagtcagcgaagacctgggcacggatatgctcgccgcggccgacgccttcgccgaccgtgtggcgcgtgtaagcggcggcggcctgacgatcgatgtgcgcacgggccgcgccgaattcggcgcgctgtcgcgcggcgacgcagagctgatgctgctgcgcaatacgcagttggcgcgcgcaaattcaatgttttccatgttcacacttccgtttttgtatgatgacaaccggcatatgagccttgcgctgaatgcgcagaatgtgcgcgcacaagtaaacgagacgctcgccgggcagggtgtcagcgttctgacagcgatttatacaggcggcctcttttttgtcagcgatgcaagcgagctgcgcactcccgatgatttccgtaatcttccgatcgctatgcgtacagacagttctgacaagcttacgctgcttggcgcactcggcgcacgggttgtaccgtattccaaagatgcgatcccggcggcttttgacacgcaggcccagtatctgccgtctgacggacagacgccgcagacggttgcgatcggcacagcggaggtcgatgcttcacagcttaaacagatcgacgccgatcccaatacgctttatttaattaaatcgtaccatacctgtacgccggtttggctggcggcgaacacggccgctgtggagagccttgggagctatgaacaggccgttttatccgaggcgtgcgtcgggctgctcgcggagctggaagaacggttcatcacaacagagcaagcggcgatcgatgcgtcggagcgggaaggaatgctgcttgttgaaccggaacgcgcacagattgccgctgcgctttacgatggaacagcagagcgcgcggtggtgctgccgtcatattttgaccggcggttgtatgatttgatcgaatcatatgccacgctttcctgaggtgatggttaaagcggactttcaaacgcccgcgcaaaaggcggagcggccggccaattttttatagattgcaccgaaatcaaaaaaagggatccgtcactgcggatcccttttttcttattcatctcggataatcagcccacttggggaacggtgaatgcggccgctgccactgtttgcgtcgtaatccggatcactgccgtcaaaatcctcgtcgtcgcggcccggcctgcccccgaggtcctcggcaattgccgcgtcgcaggtggtgcatacaggcggcatgttcgatgtcttataccagccgacggcggtggttggacagctttcaccggctaaatcgccggaagtggtacaatacgtcgcttgctgcacatcgccccaaaccggccattgctttggttcaagaccttcgtgaagcggtcccatcaaagatttgtatagcaccggcggcgggtagggaacgccggtataccggatgcgctccggctcgtcgtaacccatccagatagctgtgacatagtatggtgtgatccccataaaccactggtccttgtcgtcgtcggtcgtacccgttttgccggcgaccggatagcttgcctggttaaacggggctgcgccgccggttccgtaaggaccggtcgtaacacgctgcatcaggcggttgacgatggtggccgtttcgggcgaaatcacacggcgcggcgtggtatcgcgtgtgagcagcacatcgccgtcggcgtcgagcacctgcgtataagcgtacggctcggtataatagccgccgtttgcatagatctgataagcgcccgccatctcaagcggggtgacgccggttgtcaggccgccgagcgccatcgggaatacgtcaatatccgaggcgacgccccacgacgtcacaagacggtctacaagcgaagtcatgccgagtttgtcgtgcatgaaatcaaaggcgacttttggtgtaatctgctggatgatcttgaccggaactgtgttggtcgaccgctggattgcctcgtcaattgtgatcgggccgagataggacatatagtggttgacgagaatatgcccgccgcccagatcgatcgggctgtcgtcgattttggacgaccaagtgtacatatctgtttcaatcgcctggaggtaagcggaaatcggcttgatcgccgaaccgcactggcggtatgcgtcggtcgcgcggctgtattcacgcatccctttcttttcgccgatcccgccggccagcgccagaattttaccgtttggatcaaggattacagcggctgactgcggatattcgccctggtttgtgacggtcgggaaattcttgacgtcgctgtaaaaatcctcgacataattttgcatatccgtatcgactgttgtatagatccttagtccgccgctcgtaaccatctgctgcgcgacctggtaatcataaccgtactggtccatcaaatccgcaatgacctgttcgatcacgtaatcggtaaagtagctgtaaacgggattgacacggtcgattgccgcctgcggcgtgaacacaagctcctcggcaacggcgtcgtcatattcctgctgtgtcagatacccttgctcgaacatcgcatacaggatgtcctcctgacgctttttgttgttttcagggttggtaaacgggttatatgcgccgggggcgttcgtgatgccgatgatcgaagccgattccgctacggacaattcggaaacgtccttgccgaaatagacattggcggcagcctgaacgccataacagccgttgttgaagtaaattgtgttgaggtaagcctccaaaatctgttcgcgggaatagcgtttggagaggttgagcgcacggaaaatctcacgcaccttgcgctgcacgttgacagcgtcgtcgtcggtgatatttttgatcaactgctgcgtgatcgtcgagccgcccgcctgggttgggtatatgggaataaacatattgacgaacgcgccgaacgtgcgcttccaatcaacgccgttatgctcccagaaacgcttgtcctcgatcgcaaccgccgcgtcaatcatatggcggggaatttgatcgtaatcgacccatatacggttctcgatggtctggagccgctgaagctccacataatcgcctgtttctggatcggtttcctcggtataaaggatggtagtgtaacgcatgtcgatgttgtcaaggctgacctgatcgtccgagttgacataacgcaggatatacaccgtcagcacgcaagcgatgatacagcctgtgatgatgcccaccatgatcagagcggcaatcacacggccgatattggcaaaggtaccgccaatgatccggccgacggaatgctctttgcgtgaactcaaattagaagccccctttgtctatctaaacaccatgctggcctttttttagaattacataacttatagtataccacatttgccatgcaaagtgttactgatttttaaacgaaaatcagtacacaaattcgcatgtgattgacacgtatatgtatattttaccttaatagtgccaaaaatattgtaaacgaatccacggcgaaaaaatttttttgccgcggcggcgcgaagccggccgcagcggccgcgccgattctgaccggagggactcttatgcgcaatgcaattttgctcaccctgattggggtgatcgccgtatcactgattaccatcggcgtggtttacgccctgccgccgcagacaccgtccgtattgacgccgtcgggcgcgtccgaacagattgtctcagaggatacgtcgaactatccgtacctgctgcgcacctatgagggcaagctggcggtttttacagacgaccttgtgcagccggacttggtatttgatgtgtatgtgcgcacactgccggaacttgaccagcagcagctttcccgcggaatccgtgtgaaaacgtacgatgaattgacctccatgatcgaggattatatcagttagttgcgtgttaccgctttgtaacgattacaggggtgtttgtaaccggattgtaaccggattgtaatcgaaaagggaggaaatcgtaccgccggtgttctataatataaccatggtcggctttggggaaagccctcctgaaaaatcagttttaaagcgggtctgatcaacccgggtgtgcgctctctttctctcaggaggctgtcgtttgacagtctctttttttgtttacgggcggccgccccggagatattgctgatagataatataaagcccatcgagcgtcagcgtgcggtccacacatttaaaaacgccggtttcctccgccagcaggcttgcaaggccacccgtggcgatcacctgggcgcttccgcccagctcctgcttcatggtatttacaatgttgagtactgcgcccgcatatccaaaaaaggcgccagcctgtaagctggaaaccgtattgcgcccgatgacgctgtccttgcgcacaagctcgacgcggggcagcttggctgttttatcaaacagcgcgcccatcgagatccggatgccggggaagatcgcgccgcccagataagccccgcttggatcgacggcgtcaaacgtagtggctgtgccgaaatcgacaataatgagaggcccgccgtatttatgatacccgccgattgcggcaaccaatcggtccgcaccgacttccttgggttggtcatagcggttttcaattgccagcggcaggttgtcgcccactacaagcgggattttgttataaaaatactttttcaccgcgttcacaatggaatgcatgacctgcggtacaaccgaggtgattacgatgtcctttaccgcgcggcggtcaaaatcgttctcgcggaaaaattgcgccgtgaacagaccgatttcatcggaagtgacattgtggttagtcccaagccgaaacgatccgatgatatccggacctttaaacagaccaaattcaatgttggtgttaccgatatcgattgtaagcagcattatgtgacctcccgtaagcttgatagctgcaatcagtataaaacccgcccggctgttcgtcaacaaaaaacggaaaatctttgaaaaaatttttggaattcatatgaaacctattgacggacaagttgtttaatgatatactatttaagcgtcattaagttcaaacgctagtatggctcagttggtagagcagcgcattcgtaatgcgcaggtcgtcggttcgagtccgactactagctccagactgcctctcttgtccgtatggatgagaggggcattttgcgtcgtttaaaagctgtaccaatgggaaacgcacatgccttgacgcaaaatttcctgttcggagcgcgtcagaaaagcttgaaatccgtcaggattcccgcgcttcccccaattggcgcagcttcttaaaattccatataatgaatggataaacttgtgtgcggatataaatcggaatgaggaggatgtttggtgatcttatatttttccgggacaggaaacagcgaatacgttgcaaaaagaatcggaaaagaaatcaatgatgaagcggtaaacctgtttgaaaaaatccgaggcagggacttctcagagatgaatacagaccgtccttgggtgatggtcgtccctacctatgcatggagaatcccccgcattgtgcaggagtggctggaaaacacacgtcttactggcagcagggatatttattttgtcatgacctgcggcgaaaatattgggaacgcgggcggatacctgcaaaaactgtgcaatgaaaaaaagatgaattatatgggctgcgtttcaataacaatgcccgaaaattatattgcactgttttcaacgccgacacgggaacaggcgatgcagatgattcagcatgcggaaccagacatagacagggctgcgcttgcaattcaacgcggcgagatgtttttgcagcacgcggctgccgccaaggacaggatactcagcggtttggtcaactcccttttttatccggcttttgtacatgccaggaggttttatgcgaccgaagcctgcatatcctgtgggaagtgcgtgcgggtctgtccgctcggcaatatccgtctggaagaaggaaaacccgtatgggcgaacaggtgcacacattgtatggcctgtatctgccgctgcccgtgcgcggcaatcgaatacggcaagcgcaccaggaaaatggagcggtatacctgccccaaaaatatttgattgcacacagacaaaatacaggcatgtattgccatccatcacaacaaaacaacagccgcccatgtccttttgacatgggcggcttgcatttatgaaacaatcaaccgagcgccgcggaggcagcgtcattgtccgcacatgcgatataaatcagcagatcgccgcgcagagttaaaaggtgccccttgacacgcgcgcactgctcaggctcataaagctccaattgcgaggcaagctttccgatcgcgtcggcgatgttgtttttgacatcgttttcacggccgtcggcaggatgcagaatgaaataaaaacaactatcctttgcaaagcagatccgccagtcgtcaagcagcgtacaatcgatgccatatcggtttagaagctcgtcctcgtcgggatgctgcgggtccgcgaacagcggatcgcctgcgtcatccgtcagggcttcgagcgtttgtgcaagcgaagccagctgcgcaggcgctgcggcaggctgcgctttgccggaacaggctgtagaaaagaggcacagaatcaaacagaataaaacggccaaagtacggccaaagcggttcataggttggtcctccaaacggtgaattttatgtctcatcgccataatagggatgtgtcagaatatagttgcggatgatctgatacgtttcctcgcgcggatggataccgtcggagctatacagggaatcgggaagcgcgcgtccatctgcgcccttgagggcttcggcgacattgaggaacttcacattctttttgcggcagacctcggcgagtgcaaaattgatccggttgcacttatcgttgttggtggtgtaggcggcgtttggagaatcgtcataacgtccatcgaccggatagatcgatgagacaacaatcaacgtattggggctggccgcacgcagcgcatcgatgaaagcttcataatgctgcgcgtattcctccggcttcatccaaaaggcgcagttggagccaacattgacgacaacacgctcaggttgaaaccgtgccgctgcttcgcaggctgtcagctccagatcgcgcccctttggcgagcggccataaattgtaatcggcgtatccaaaatagtgtcgggctggagcgccggcttggaccagacgctttgatagggatagcagccgaacgcaagcccgttttccgtgatgctgtcgccgataaaaaccgtatcctccagatagctttcatcggccggagctgtctctggcaggataacatctgaaaaatagccgttgagtgtgaaatccgcaatccccattgttaatggagaggaattgtccacacgtacacgacgtgtagctctggcgatattgccgcttgaatcagcggcctcatatacaagctcgtaatcccctatggcgcttgtgtcgaccattccatggactgttacgcgcccggttatatcgccgtcccagttgtcaacggcatcatatcccgggtcctcaaagacgctgttcagagcgaccgtcagttcggggctgcccttcaggcgcaattccggaatggtgatatcgcggacctgaacattgcgggcaaggggtgtgctccagggaatgccgtccagtcggtaccaaattgtataattgcccggggtgctgtcatctacagcgccgtctgaagaaatccgatcggatagatccaatccgaatatagacgcctgcgcaccttgttcccggtaacggtcgccaagtgcaacgacggtttcggcgctgccattgagcgaaaaatgcgttgtcagcagggcagccgctccggcggcgagcaacacaaaagcgccggaccctgcaagcagccatttcgggcgctttttagcgggtttggctgcctggtaatcaagctttgtttccatattttttatgtcctttatcaaaacagataaaccgttgatgcttgcgtaaaaaaatggtggatgcttcctttaaaatatcatatcattttccgtcggtttgtaaagaagtttttgtttttttgcagaaaatagttgtcgtacatgtgttttttgcacagccggttctctctgcctggcgggctaaacgacaaaaagaactggaatctctcatgaaacggtggtataataaccgcaaaacggttattataccatgtccgcgaagcggcatggtataatcggccatcggggcggaagcgggccgcgcccgcgtatcgccccggccataagattggtataataaccgcaaaacggttattataccatgtccgcgaagcggcatggtataatcggccatcggggcggaagcgggccgcgcccgcgtatcgccccggccataagattggtataataaccgcaaaacggttattataccatgtctgcgaagcggcatggtataatcggccatcggggcggaagcgggccgcgcccgcgtatcgccccggccattggagcacgggacatgccccaagacatgagaggatgagacagtgaaaaatctgaagcagtattttgtggcagcggtcgttgtctgcgcgctgctgttggcaatgccgtccacagcgttcgccacggacgggcaacgtatgcctgacagttattttgacgacgcagtgttcgtgggcgattccatttcactcaagctgcgcaactatgtctataagcagcgcgccggcgatccgggttttttgggaagcgcgcagtttttgacagtgggggggctgggaagcggcaacgttcaattgccaattacagcggattccctgcatccggtttataatggtgaaaagatgatgctggaggattccgtcgcagcttcgggcgcaaaaaaagtttatatcatgtttggtatgaacgatattgtgccctatgggattgatggcgcaatagaaaacttggacgtactgattggaaaaattctggagaagtcgccggatgtacagatcgcagttcagtcagtcacgccgattttgcaaaacaggcagcaaaaaaatttgaacaatctgaatattttgttgtataacgaacagctagaggcgctgtgtgatgcacgtgggtacgattttcttgatataggcgctttgatgcgcgatgaaaatggcgcgctgatttatgagtattgcgcagatgcgccggggcttgggatgcatctttcagatgcggcgtgcgagccgtggatcgagtatctgcgcacacatccgctcggcagcggcgccgatctgcttacacctgcgtccgaggaggacgcaggtcaagcggtggacccgcttttgagccggcctgatgattttgccgaagaacaggtggacgagcctgccggcgagagctttgaaagcggcctgaagcagccgcctcaaaaacgggatcccaaccgcagactgaacgcgcggtagggacttttgttgtatcttgaaagaattggacgcgccaattctgtaaaagcgccggcgtattcacgccggcgctttttggcacagtgcggcctttaggcggagaaggcgctgttgattccgcattcaccaatcggataaaaatttgttgatatttatatcaaatatgatataatttaaaaaataatatgtatacgcgttatgaatactgaatttgaaattttaacaataaaaacgcgtatatataaaaacgagggcgcgctgacgcggacgcaggcaatatgggagagacgtttttacattacgtgaagcagcccggaaaatgaggagaattgagatgaaaaaactggcggtattgctgctggcggcttgtgtggcgctgggcggcgcgggatgcaaaaacagtgtttcggatacggtttcaggcttggtagaagatgcgggtacagccattcaggccgacggccgcgagtatgggcagacctacacctttgaatcgggcgaacttgtggaaacggcgttttttaatttccaggtaaacgaggtttcaaccgcggccgagatagaaggctatgtgcccgaggatgaaacgaatcaatttttggttgtcaacgttacaattaaaaatacctttgaggatgatgcaagtatcccgatgttcgctaccgattttcagcttatttgggcggatttgggcgacacgggaatttatcccgatacgcaattcgctgaggggcagcttcctgaggagtatcagttgttgaagggcgacagccgcactggaaatttgatttttatcgtgccaaacgatgtcaccgaatttaagctccaatatctggaggtctggagcgatgattttgaggggaatacatattttgtaaatctaaagctttaaagccagacgcacaaaacggccgtccatacagttgggcggccgtttccctgtttgtgccggcatggccggagggccatgccaatgggtagaggaaaggaaaagaggagagatatgaaaaagaatatataaatcccttgcgggaagaactgtttgatttgccggaatcgggccggtgttccgtccacccgctccggctttgctgtttggtatgctcatagtatacagagcaattatggatggggttttagaataatcgaaacaatgtgaaaagaatttgtgaatcaaatttgaacctggtttaggacgccggatttcaacatacaggtgtgcgcagaaaggcgaggagctgttgattgaagctgcacagctcgtcgtaaaatacagcgtggccgctgttttcaaatgcaaaaagttgtgcacagtctgtggaagcctgcgaaatacaggcgtcggcagctttccgcgtcacaccgcaaggaaagtcgctgcattgcgtgaaacttggagaggccgcgcccggagcacaagctatttggcttcgtagctattgtaagacgtgcgatgctcaataaagtcctgctgcggtcatgcgtccgtttcttctatccagcggtcgagccggcgcgattcgtggacagcaaaacaaaagacaaggattccggcagtgatatcggcgaccggaccggcgtacaggatgccgtcaagccccatgaacagcggcaggaccaaaatcaacgggatcagcaggatcaattgacgcagcatcgacagtgcagacgccttgagcggctgaccggtcgcctgaaaatagctggtcgtaacaatttggaaaccggagcagaaaacgccgaacataaagatacgcatacatttgaccgcgaaatcagtaaagagctgtccgccagagccaaacaggcgcagcagaagctgcggcgcgaggatacagacaagccatcccgctgttgagacgatggtggccattgtaacggcgatgcgataggtctgcttaatgcgccgcggctggttggcgccccggttaaagcccaggatcggctgtgaaccgattccaatgccgatgtcgacagcaatgaggatggcgctgaccttgacaacgatgcccattgcgctcaatgcaatatcgccgccgaccggcgactgattgccgtaatagacgagcgagttgttcattgcaatttgcagaatggtggaggcgagctgcgtgatgcagcttgaaacgcccagtgcgatcactgttttgcagatatggccggctgggcgcaggtttgcccggcgcagccgcatcttgccgcgggacaggaaatataccgtcagtacgacggccgaaagaatttgcgaggtgatggtcgcaatagccgcgcccttaacgccccagccaaaaatgaatatgtagatgggatcgagaaccgtgttgagcgcgcatccgatcaccatgctgtacatggacaggcgcggatttccatctgtgcgggccatgtttgaaagcccgacactgagcatattaaacggcgcgccgattaggatgatggaggcgtaatcgcgcgaatactccaagttttgcgacgtcgcgccgaacagatgcaggatcgggtccaggaatatcagcccgaccgccgccaacaggacgccagcggcaagaaggagcataaagacgttgccaagcgtcctctcggcctcctcctcgcgtttttcgccgagcttgatcgcggcataggcgcttccgcctgccccaagcagggtgctgatggacaacatgattgtcacgatcggaaacgatacggttgtcgccgcattgcccagaaaaccgactccctggccgataaaaatctgatcgacgatgttgtaaaccgcgctgaccagcatggaaatgactgccggcagcgcaaactgtgccagcagcttctgcaccggctcatatccgagtgggttttgttgtttttcgatggcttgtcccattgcgtttttattcctcttttcccgtttgatcagcctgcttgtgtgcagcacgtccgtgcggcgcgctgtcattggaaacatattgatgcgcgttctgtgacatcgccaccaaaagcgttttggcagcttcacgctgctttgatgtcataccctgggtcagaatatcattccagcgctgccgcgccgcgagcgtagcctcgatcacagggcgggccttctccgttacgtaaaggcgcacgacgcgccggtcatttggatcgcccacgcgccgaatgtatccaagctcctccaatttttggacggcacgcgtcgcggtaccgcggtcaaaacttccgatctgcgccagttccagcaggctgatgccgggaagctgcgagatgcgaagcaaaaaaaactgctgtccgcagccgatgccatattcacgcagaacgtcgtcgtagtacgactgtccgcagcggtaaaggatagagatgtgcttgctgaaggaaaattggccttgttccatttccataatcatacctcgctttttgtaaggcggctgctctataacatgagatataaacagcataacacatattggttgcacatgcaatcatttaagggaaatttatcagattttctgcatcgaaattgacaggcggcatatttctgtttatgatgattctgttgacaaacaaagccgtgctgaaaatgagaacaatttttctagcggaaaaaacaaaaacgcgggcatgcttttgaaaactcacaagtatttttgcgaaagctgccggaataaagcgccgctattttggatgcggcggctttgccagcgggtccaaaatgtaaacaggaaggagggagtgctttgaaggaatttaagagacagtacccattgttttcactctgcgggttgaactgcggattatgccccatgcatttaaacggctactgcccgggctgcggcgggggaaagggcaatcagccctgcgcaattgcacggtgcagtctggaccgcggcggaatcgagttttgctgcgactgcatagaatatccctgcgctcgatatcaggcaatgacggaatacgactcctttatttcgcaccgtcatatggcgcacgaccttgcgtggctccagcagatcggacttgacgcataccgcgccgaattggaggaaaaaattaagattctgcatacgctgcttgacggctataacgacggacggcgaaaaaccttttattgtacagccgtcgcattgctggatctggatgccattcgcgatgtgatggacgggcttgcgcagcaagaaaatgatgaaatggcggccaagcaaaaggccgcatgtgcggtgcgcttgtttgagcaagtggcaaatcagcgcaaaattgtgctcaagctgtgtaaaaagccgaagaaaacggctggcgccgccgaatgaaaaacgaaaatgccccggccatttggccggggcatatccgcaccgtatttaaacgtcattgtgcctgatcgactgctttttcgcgttgttgtgctggttttggttctcgcgggtcagcggcgtctggccattacattttctgatgcggacttctttcttatccggctggctgtccttgggcattgcgctcgcctcctactgcgtttggatgttgctggcgtcggccgcgatttcataaccgagcctgttgagccggtgttcgatccggtcgtaagtgacacccgagctgtcataatcaacgctgacaaggtggttttgcgtgttgacgctgacggacgatacgccgcgaagcgtatcaagctcctgtttaagctccttcaggtcgtgtttgccgtcaaggtttctgacaatgaaataggcgctctctcgagacatgttctcatcgtccttttgccgctgcgcgccggcgttattcggccgccgtcccccgtcgtgcgcagggtgtgtgccggcgggtcgatcttacagaccgggcggcgtgcgcacggctttttcaatccgtgcacgcgggggaaacgacgcggtgcgttttttcccccgcgattatgttgccctcgtccgcttgtacgatgcgcgccaatttttcgcagccgttgcggctgaaaacggcgtggatactgctaatttttgttaaaaaacgcggcccggtttgggccgcgtttttagcggaggctacgattgtccgtgctgtttttcaagcagcctgtccgcaagcgcggcgtccggttcaacaatggcagtctgatacggctcgtagagcacaagccccggcctgccggacggatgtttccatacgttgcgcacctgtgtatagtcgactgcgacctttcctgattcccgcgccttggaatgatacgcggcgataacggcggcctgttcaagcgtgcggtccggtacctcctgtccttgtgtcacaatcacgacatgcgagccggggatcttctgcgtatgcagccagatatcgtttttgcggctgtccttgagcgtcaggcggtcgttttgcaggttgttgcgtccgcataaaattgtaaagccgtcatccgagacgaagcgcagcggcgcgagacgctcctctttcatgccgcgccgcgccgcgcgccgcacataaccctgtgctgcaagctcctcgcggatggcgttcagctccgattcgagcgaggcgcgcgccagctcgtcaaatacggtgtcgaggtaaaccagctcggactcgccctgttcgatgagcgcgcgcagcttcttttcggctgtgtcggccttgcggtaacgcgcgtaataccgctgcgcgttctggctcggcgtgagcatcggatcgagcgggatttttattttggggctgccgtcctcatagtaattttcaacctccgcgattggctggcccttctcaaggctgtaaaggttcgcgttgatcaaatcgccgtaaattttaagcgtttcgcgctccgtcgattcaagcagttccttgcgctgcgccgccagcttgcgcgcggtgcgttcgctcagattcgcaagcaggcgcagaaggtccgcgccgcgctggcgcatccggtcgatgcggtcgcgctcgctgtaaaagctgtcgagcagcgcgctgtaggtgtcaaaatcacggctgacaagcgtatgcccatactggttgatatcgatataggtaaaatccgacggcttgccggcggcgtcaacgagcatcacaggatgaacttcatcgcggttgagcctgtcggagagctgtgaaagataaaatttgagccgtgtttcccgctcgccgtcaagctgggaaacaggcgtttcccagtcgcgcgcggcattccaggcgatttcgcggcagacaagcggactcatgccctccagcgccgatatcagcgccttgtaaagcggctgttccggcgtatcatgcagccgctttacaatttccgacggcgcggccttatagatgtccaggcggctgccggcaggcacatgggtgtacgtcatgccgggcaatacaggacgcacccgcgacatttcatcgcttacgcgtttgaccgcgtcgatgatacggccttcctggttgacaaggataatgttgctgtgccgtcccataatttcgacggacagcgtcagtacgacgcggtcgccaagctcgtttgtcgtttcaaagtggaaatgcaggatgcggtcaagccccgcctgtgtgatatcgacgagctttgcgcctgtcagatgcttgcgcatcagcatacagaacatcggcggagacttggggttgtcctgcgccagctcggtgaaatgcacgcgcggattcgacgccgacgccgacaaaagcagcttgcggttgccggcgcgcgcgcgcatggcgataacgatcgtttcacgggccggctgatgaatcttgtcgacgcgcccgccgacgaccgcgccggccagttcgcgccgcagccgggtcaaaaatactccgtccagaggcatatacgttctcctaaatgtacaaggttttcgatgaaggataaaaacagggggcgttgacagccgcggaccgtttaaagcgtcttgagaaaacggtcgatccgcttaagggcttcgagcaaatggttgacggaataggaataggaaatgcgcacaaacccttcgccgctttcaccgaacgcatcgcccggaacgacggcgacgcgctccgcctccagcagacgcatacagaagtcgctgctggaaagacccgtcgagcggatgctcggaaagacatagaacgcgccctcgggcgagaagcagtcaagccccatgcgattcagtccatccacaagcagacggcggcgcatatcatactggccgcgcatctcctcaatgtcggcgtcgccgtttctgagcgcctcgactgcggcgtactggcttgtcgtgggggcgcacatgatcgaaaactgatgtatttttgtcatctgcttaatcaccggagccggacccgccgcatatccaaggcgccagcctgtcatggcgtagcttttggagaagccctgcaccaggatggtgcgttccttcatgccgtcgatttcggcaaacgagatatgacgttcgtcgccatacgtcaattcggcgtagatttcatccgacagaaccatgatgtcggttccgcgcagtactccggcgattgcctccagatgtgcgcgccgcatgactgcgccggtcggattgttggggaagggaaggatcagcagctttgtgcgcggagtaatggccgccttcaattgctccggcgtcagtctgaacgcgtcctcggcgcgcgtggcgatcggcacgggcacgccgccggtcagctcggtaatcggcgtgtagcagacgaacgacggttccacaacgagcacctcgtcgcccggctcgacgagcgcgcggatggcaatatcgattgcctcggaaccgccgaccgtgatcaaaagctcttttttgggatcatattcaagcgtgaagcggcgctttaaataaccgcaggccgcctcgcgaagctgcataagcccggaattggccgtataccaggtatgcccgcgttccaggctttcgatgccggcgcggcggatattccagggcgtcttgaaatcaggttcgccgacgccgagcgagatcacgtcgtccatctccgcggcgatatcgaaaaacctgcggatgcccgacggcttgattgcaacggcgcggcggcttaaaattttgtcgtagtccatcacagggaggttacctcccgttcgtctttgaaatcgtcaaccatcatctggccgcgctgcttgtactttttcagcacaaagtgcgtgctggttgactggactggttcgagcggcgcgagacggtgcgccacaaaaagcgcgatgtccttgaacgtctttccgctgattgtcagcgccagatcatagccgccgctcatcagatagcacgtttccacctcgcggaactgggagatggtgtaggcgatctcctcgaatcccatcgtcccctttggaattaccttgatctcgatgcgcgccgaaacaaggttgcggtcggtctgatcccagtcgatcagcgccttgtagccacggatgacgccctgtttttcataaccggcgatcgtctgcgcgacatcctgcgcatcctcgccgagcatgacggcaagctgctcgtttgtgagcttcgcgttgtcgtcgatcagccttaacagtttttccttgttttgttccttcatgcttcgcgcacccctttttcgtctgttcagataatcttaaactggagcggatggcgctccttataaaatgtgaagtatgaaaatccggcttcaagcagcatttccattccggaatcaatgccgcggccgagcgcgtcggccgaatgggcgtcggagccgagcgtgatatactcgccgccaagctcccggtaccgtttgacatagcaaagcggcggcatggtgtcgcgcagggcgccgtacagcccggaggtgttgatctcaatcgcgcgtccgttctgcgctgtaaggcgcagaatctcctcgatcttgtcgtcgtagcggcgcaggtcgacgcggattttatgcttgccggtgatgtagcgcagcggataggtcagatgcccgataacgtcgaactgattaagctgtgcggccttgatcagatatgtaaaatattcctccagcaggcggtcgatatcgccgctgctccacgcgccgaaatcgctgtaatagatatcctcaccggacagtgtgttgtgctgtgaaaccatcaccatgtcgaacgggaaacgctcaaggatggagctggtcaaagccgggtcgtaaagcacgtcggaaagctcgatgcccgccataaccgcaagctttccgttaaacacgcgccgcgctttctgcacctcgaatacggactgtgtaatacgcatttcgtactggccttcttcaaaggtgcgcagctcgcagtgatcggtgatgcagatgccggggatttccttctccacggccttttcacacataaacatgacggaatggtgcgcgtcggaggaattgtcggaatgggtgtggctgtcaaagatgttgctgaacataatgatcctcctgtatgtattcagggcttgtttgaaaatagaaaaagtacaggattacccgcataaaaagacggttgttccgatttttcaaacagccaagatcaatggggcggcttatgccgcatcccaccgggaatctgcgattcattttcatagtatagcatacggcgatataaatagtatagcatttttatgaaaaatgtgctatactattccaaccgtgatacaaggcgaacggccggcgcgggcgccggcggtacaatcaggtttgggaggtagcagagtatgcgtgctgttttgactgtcatcggcaaggaccatgttggtatcctgtccaaggtggccaacaaatgcgccgagtgcaacgcgaatatcattgaggttacgcagaccgttctgcaggatttgttctgcatgattatgatgatcgatatttccagcgtcaactgcgagctgtccgagcttgtctatcagatgaaccagctcggcgaaaaggccggcttgtccatccatgtcatgcatgaggacgtgttcaattcgatgcaccgcatctgacgaaggagtaaacttatgcttaataccagcgatgttcttgaaacaatccgcatgatccaggatcaaaacctggatatccgcacgatcacgatgggcatatcgctgcttgactgcgctgacggcagcatcgaacggtcctgcgaaaaggtctatgacaagattgcgcgctgcgccaaagacctggtaaagactggcgaggcgctggagatggagtacggcatcccaatcatcaacaagcgcatttccgttacgccaatcgccatgctggccgccgcttccggcggcgaccccgtgcagtacgcgctggcgcttgagcgcgccgcctgcgaggtgggcgtcaacttcatcgggggtttttccgcgcttgtacataaaggcttcgcagcgggtgacgaggcgctgatcaacgccattcccgaggcgctcaaagccaccgatcatgtctgcgcgtccgtcaatatcggttcgaccaagacgggcatcaacctcgacgcggtcggcctgatgggacgcatcgtgcgccgctgcgccgagatcacggccgacgacaactgctttgcggccgcgaaactcgttgtgttctgcaacgcgccggaggataaccccttcatggccggcgcgttccatggggcgggcgaacctgactgcgtcatcaatgtcggcgtgtccggcccgggcgttgtgcgcgccgctctggccgccgcgcccaaggacctcaatatcactgaggtcgccgagctgattaaaaagacggcgttcaaaatcacgcgtatgggccagctgatcggttccgaagcgagccgccggcttggcgtgccgttcggcatcgtcgacctgtcgctcgcgccgacgccggccatcggcgattccgtggcgcacatcatcgaggaaatcggcattgaaaagtgcggcggctgcggtacgacagcggcgcttgctctgctcaacgacgcggtcaaaaagggcggcgtgatggcgtcctcggctgtgggcgggctgtccggcgcgtttatccctgtttcggaggacgcgggcatgatcgacgcggcccgctgcggcgcgctttcgatcgaaaagcttgaagcgatgacggctgtctgttcggtcggacttgatatgatcgccgttccgggggacacgcctgccgaggtgatcgctgcgatcatcgccgacgaggcggcgatcggcatggtcaattccaaaacgaccgccgtgcgcatcatccccgccgtcggccgtgaggcgggccaggagcttgaattcggcggcctgttcggcagcggcccgattatgaaggtcaacactttctcgccggcccgcttcataagccgcggaggccgcatcccagcgccactccaatcgctgaaaaactgatagatatagtatagaacagcccccggcttctttggaagccgggggctgcggctgtaaagagggagaaaaacgtccgtttaccttccggtatttggaataggtttcgtgttctggttgatgttgatcgttggtcccttgttggaattgttctgattattgctgctattattgttattgttgttgttcgaaggtttctttttatcgacgttcgccttgccatcggaaatgatataggtaccaagcgtgcgtgtctggagcgtcagcacggaatcaccgtcgtcattttcaccaaaggagaagctgtttgaacggtcgatcagttctccgtcaaccacctcataaacatagatcttgtttttgctgacggtcatacgtccattgccgtcgacgtatggattatagagcgacagtgtcgcgcgcgaggtacagggcagctttggattgcccacgaaatcgtaaaggtaggcgtcgcggttgttaaaatattcagtgtagtcctcattgttccaggccgtcgaaaggcgcgggcaatagtaattgacctctgaatcggcgcggaaacggaccgatgcaatataaccgttgctgttttcccaggtgacggtgttgatctcgtttttaaccggcttgatgactacgcccttttctcctgcgtagaaggtcgcgtcgtcgtccgtgatttgctggttgccgatatagaatttaaagtttttataataggtgtctcccgatttgagatagccgggggtcgtgctgccgccgacactggacaggcggtcgatctcggcttgtttgtcgttgatcgcatcgagccgcgctttgcgggcggatttgacgctgctgacgagcggacgcacctgctcctgcgtaagggttgtgccgggaatgacggttgaatcttgttgttgaagctgcgcaagctcggccctgtagccttccaactttgcgccgtctccggccttataagcggccagggcgttctctgcgtcacgtacagcctgctgtgcggcggcgatggtattttgcaggctgttgatctcttgctgcgccgtggggatacggtttgtttcgtaatcattgaccatcgctgtgagtgcgggcgtttcagattggacggcgctgcggatcgttgcaatcgccgtgtcgcgggctgcgtcggtgcccgcatttgcatttgcaagaacagcggttgtggcgctcatcatcatgacatccgcttccccatcatctccaacgctttccattccatcgtccagagaatcgtccgagtcgacagagaagctgccgtcgaggtcgccgaaagcgtcgctgccggttccgggcggcgtaaccggtgtggctggcgtgaggttggagggcggcagcggcgcgctgtaaacgatggcgtcaagcatgttcggtgtgatcgcagagccgtcatacatcgaggtttgcgctggatgatatttctgcacggcggccttgagcgcattgaaggtcgcttctgaaggcgcggcgtcataatttgccagtgcggtactgatccctgctagcagagattgacgttctttgaagtttgccagttcggtgcgcagatcatttaccttttgctgcgcggcggcgctgtccgggatgctggcccgcttattggagagatctgtctcaagccggcggatttccgtttcaatacgggaaatctcctgattcagataatccatgcgttccttgcgcttggccgcttgctgggatgcctgttgattggcctgattgacgctcgcctgagacggcaaaccagccagaagcgaatcgagctgcgcatcggtcagtgatgtaatggatccccaggacggcgttgcgccggacacagcgtttgcaagtgcgttttcagcatcaataatcgcctgcaaaagctcattgaccctgcgctcggagcttgtggccggagaggagaagggcgttttgttattgagcgcgtctttttcccgttgaagctgtgtcaggacggcgctgccgccggtagatgtatcgctgctggtagcgggccggaaactggggaagctgccggatagtccggatgtgatcgcgaccaagtcctttttggcgcggaactgggcctccatctcaattttgtattcatcctcggtaaaattatctttcacacggaattgaatacaaacataccggttgccgccgaattttttctcaatcagctcggcgtcgtcgatgtatttgccatttgtttttttcttcattgagaaacgcagataatcagaattcgtcaggatatcataatcgcttgatggtccaatcacataataatagtagctgcctggggcatatgcatcgtattccgtgtcagcgatttcaccgtcgctgtcaacgacctggtcaatgatgctgcggtcataagcgaaggatgtcacactgattgagaaagcgcatgcacatgcaagcagcgccgcaacgattcttttcatattcataaaaagcgcctccttttcggcttgtaattgagaaaatcagtttggtgtggccggctctttactaatataaccaaaatgatttccagttagggacattgtatttgtaacaattctgtgaaagaactgtgaatgtctgtcctttcaaaaaaggattgctgcacaggtgtgcagctccaggacccacgcccagtgctgcggctgtcggatggattcaaacaaacaggtgcgcttataaaaataaaggcggccggcagttagttttacgctgataaggaagtattcacaacaacttatcactaacgctgacagacagggtgcaaacagaaacagagggctaatcactttcaatagtggttggctctctgcttttctatcttcactttgttacgcaatagaacgtcatttttgagggtagaagtataaaatatcatttaagcgttttacatgttctgcaagccgcataaatcaagcactttttcccctctactgcgtaacaaacctgtggtaattatccgataaagcatagaccacatatctcggttttcccgttgttggattatccgatattggattttccgacatcgggttgtccgacatcggaaaatccaacgcaattaaataaagatatactaactaaagaaaaaccaaatacagatttaatcaaatacctattcctttcctatcctttccctaatccctctcctttggggcaaggtatagcggcagagccgccggaacggaaaagaatggaacagaagcgacaatacaaaatatcgtttgccatgttacgcagtagaacgccatttttaagggtgggagtataaaacctttacccttgcccctatcgtcgctgtaacgcgcttaaatcaagcgagaaacgcaccctatcgcataacattccatactggattgagagcgcaagcggtctatccgattgcgctctcttggttgcccaacagcaaagacggaaacagtcgtcaaggacgcttgcgcaaagtttatccttgacgactgtttttggctttgctatctgttacctgtcaaatcggaattgcaagatagctttgataagctgtgcttttaagcggtcttgaatatcgtcgttgatatgtccacgataggtagacaaatattttatacgcccctcgtagtgccgcaatactgcggctatcgcttccggctctccggcaacagctttttcaatggtttcaaagggtatcagcttcttattcctcatgtttcgttttctccaattcttttcttaactgtttcaatgccgccaacttccaatagtttactgtgcttctgctccgtccgtactcattcccgatttttctttcgctgtaaccgaggaagaaattcatcagcagaacagtacgcctttgttctgacagattagctaatgcgtcggctaaccgtctacttgtaacgacaacttcttttccttgcacgacaaaaacagtcggcttctcataaacatactgctcaaagtagttgtcggttgcaaatggttcaaaagacgtttctgacatcaaatagtcaagcgacacttcatgcttctgttttcgtcccaaatcgcggtacgcgttgattgccgcgttacggagaacgactttacagaacgcggcaaaggcatattcgatatgctccataaattgttcggaatacctcattttctcatcaccccctttcttctcagtagggggctattacgacaaacgcccatgcagacgtaaaaccgcataggcgtttggtaatatgagttatttaagtaactataatgatttgtgtgttcatctctatggttgtaaaaaaccgttgcatggaataggctttttttaacaatggaatagaattaaaaatgtgaaaaagaaacatggcaatatctcccgacaccgccatgtctataaaaataattgtgtatttgccgctattccattttatatacaggaaatggcggtttgttttcctatcacaaaacagaaagagccaataatcataagatttatttcttgtgattatcggctctgcgtcaatgcgtctggctctgtgataattgaaatattcaaattttttacattgataagattttcctgcttgcacttcggacagtataggggaaaattctttatttctgtatcttcccgtatccttaatcgggttttattattgcatacaggacataaaatccatttttcttgttgcaatgcaccacctcatttctaatcaaactacctttaatgataatcagaaacagagtgctgaaaaatcacttgtttccccaaaatggtaattgctttcttgctacattgatttacacaccgatagcataacgtacaccgtccgtctgctatcatcttatcttctgataatgacaaattgttcataggacacaccactgcacatttcccgcactttatacaagcgtcggtatctatctgtattttgtctgaatattcttgtgttttacggtaaaaccaaagccgctgtcccaaaagccctgcaatatggcataaaaatcccaaaccgtctttagttggagtaccatttttcaaattgcacaccgctgattttatgcgttcttccgcttgtatgacaatttgcttattttgagccggagtacgctttaaggcttttacatcacaaatacaatccggcattttcaaatgaagtccaccccatacctgtgcgccgtatctctcgaacaatcttgcagatacgcctgcaccatcgccgctaaacagtcccattgttgcaataatgaaaatacgttttcctttccatacatcagaattttcgcagataaaatcccgtacaattttaggtaagttactgtaatagattggataagcaaaaatgatgtctttatgatatgtaactttttccattgtacctgtatcttctaacggggttatttcaatgttcctgtcatatagagcaacaaacttttctaaacaatattttgtatttcctgttccgctaaaataaatcccaatcatattttttctcccgtattatctaaaaaggaaagttgaaaaacgtccataaaatcaatgactttctctctccagtcattatcataatttacattattcatggtggctaatgaagtaataccatgtataaaagcccaaatggttatgataatatcattttgcttttcttctgaatagtgcgtctgctctaataattcacttacaacatttttatatatgatataaggtttatagttttggtcgtctggtattgataatgataagtcaatttttatattggattgagaatataaaaattgaaaataagcagggttgtctacaaagaaagatacataggctattcccatatcttttaatatttctgcaacattattattcttttgaactgtactttctaattgtttagaaaatctatctgtgataaataattgcattgcttcaagaagttcctctttattttgaaaatggctataaggggcagcatggctgacaccacacgccgcagctacctttctcaaagaaaaagcatttactccctctgtatttacaatctgaatacctgtttcaatcaatgcgtttcgcaagtccttgtgatgataagtctgtcgttgctgttccatgctaattcctccaatctttacactgtctatattataaaactcaaactttacactgtcaagattaaaagagattttaagcaatgatactcgaaatattttcggttatttatttggcatttcaggaacttttccgtattaagagataagaaaaactttttgaaaaatttctctcaaaacttcggcaaaatcgccctatgcggtgttgtaggtagtgagaggaaaatcagagggtttgggaaacttcccaacaagcaaaatgcagcgcattttcggaaaagggtacccttttcctatgcttgctattcagttttcacttcaacaaactatgaaaggacgggaaaggaatggaaaggaaacaagatattgaaaacagtggatttataccacaaaagggcaatccgctacatgaaactgtcacttacaaaatcggcggcacaatttttgaagtgtcaacgatttgcggcggctcggaactgctttataacaaaatggaacggctcataagagcggaatccgtcaaaacgcctactgacaaagaaaaagaagtccgctataataaagatagcaacctgtttgtcgggcgttcattacaggaggaatgaacaatgacaacgacaaaaaattatcccgacaacattaccgctttatatgcaaggctttctcaagaggacgctttggacggagagagcaacagcatagcaaatcaaaagaaaatcctgctcaaatatgcaacggacaacggttttcctaatcctacatttttcattgacgacggcgtttcgggcgttacgtttgacagaccgggctggaatgaaatgataaggctttcggaagcaggaaaggtcaagacggttatcgtcaaggatatgtcccgcatggggcgcgattatctgaaagtcggctactacactgaaagtttctttgccgagcgtgatattcgctatatcgcaatcaatgacggagtagacagtgaaaaaggcgataatgaatttacccctttccgtaatctgttcaatgatttttacgcacgcgatacaagcaagaaaatccgcgcagtcatgcggtcaaagggcaatgccggagaacatctttgtaccaatccgccctatgggtacaggaaatacccagacgacaaaaagaaatggattgtagatgaagaagctgccgcggtggtaaagaaaatttttgatttgtgtattgctggaaaaggacccatgcagatagcaaaagcgctgacagcggacaaagtgttgacagtcaaagcctactatgcaaagcgtgacggaaaggctatgccggataatctctatcgttgggattacaaatccatagcggggatattggaacgcccagaatatacagggtgtacagtcaatttcaaaacgtattccaaatcccacaagctgaaaaaacgtctgcaaaatgcgccggaaaattaccgtatcttccccaacacgcaacctgcgattatcgaggaacaggtatttgagagggtgcaggaattaagggcaaacaaacgccgccctacaaagacaggacggcaaggcttattctccggcttgctttattgcgctgactgtggcgaaaagctgtacttttgcacaacaaacagttttacgcccaaacaagagcattatgtctgctccaactacaagagcaatacaggtacttgttccgcgcattttatccgagaagaaaccttaaagctgttcgtcctgcaaaggatatttgatgtaacggctatgttctttgatgatatacagagctttcaaaacatggtttatcagcagaggtttgaggaagcggaaaaggcagtaaagtggcaaaagaaagaactcgaacaggcaaggaaacggattgccgagcttgaccgtattttcaagcggatttacgaggacgatattaacggcacaatcagccacgaaagattcttgaagttgtccgcagagtatgaagcggagcaaaaggaactgacagagtttgtcaagttagagcaagctgccgttgatacttacgaacaggacagaacggattttgacagctttgctgccgttatccgcaaatatgtgggaatacgggaattaacgcctactatcgtcaatgagtttgtaaagaaaattattgtccacgcgccagacaaatccagcggacaccgcagacagaagattgaaattgtctggaactttatcggggaactggaacaggacgaggacaagcaaacggttgaacagcagagaaaaagcagaacggcatagcctttgactatgccgccctgcaacatgattaaattacttccttatgggcgtgtgcctttgctgccggccgcctttattttcgtttcattgcgtcgctcgataatcataaagcacatcgtcgccaaccttgagcgataaaggcttatagccgctgccagcgccgctgttgaacgacaggactgccttataaggctgcgtgacactctcgccgcttgcaaccctgcggtcgaatgtctgtgtaaccgtatagacggacccatcgaactgcacggaaagatccgatttgcggaaatggacgcttcctggatcgtaagcggcggcggtcaccatttcttgtgcgcaggaaacagcatattgctcatcctctgaaagagcggttgtatgtgccgctgatgatgcaaggtctgcggagtccccggtgttataagaacgcagaaaaaaaagcgcggctgccgcggcggccagaagaataaaaataaacagcagccatttgagtatgggcaaatgctttttcgctgtggcagtgtcgtcgggcgcgctttgctcaaacgccgggagcagctccggttccggttccgttggatggagcggcgtttgtccgctcaggcaacgctcgcagacatcggcggtgctgtcctcaggcagcggagcgccgcataggatacaggtgcgaaccggcgagccgtcaccgttttcaacagcagatttgaaagcagccgcagaggcgccgcagtgaaggcaatattgacttttacgcggaatacgcctgccgcaagaaggacaaaccatacaggccctcctttttgttgaaatgttgtacgaccattattatacgattgcccttcataaaatgcaaggaatatgaggcaaggtccattgaatactggataaagtgcaggaaatgtaaaaaaaggatgagaaaatgtaaaaattgtatttctttctttccgattttgttttataatataagtacagaatttattgtaaaataaaaaaaatctgcagattttgaaaaaacaattataaatataataccaatttttcaattctgtacctatgacatttggaaaaggatcgaagaatgtattatgatgtcgaaaagaggtgtttttgatgaatagcagtcagattattcaaaaaaatattcggtatctgcgtacaacgcttggaatcacacaggaacaactggcatttatttccggcctgacttcagcatgtgtcagcagattggaacgcgacagcaaatgcaatccgacagttcagacacttgaccatatcgcggaaggtctgaaaatccaaacagcacagttgtttgatgaacagcttgcgtcggaggagggcaagtgcattacagagcttcaacgctgtatgaatgagatcatgaagctggatgtggataaacagcgggatgttatccacctgcttgataattatatccaattgggccaaattttttaacatcagacgcaataaatgtaataaagcttgcagtgttgctggttctgtccattgctgcgcggtatttacatcgccctgcacgactggtataataaccgcagagcggttattataccgctctcatggccaaggcgatgcgcgggcgcggcccgcttccatcctgatggccgattacaccatgccgcttcgcggacatggtataatgatttcaacaaatggcatgccccttataagacacccgatcttcatggctgatagcttcgtatatgtaatgctgttgacttttaaaggagggtttttcgcatgcttttgtgtatatacaggtatgaaggggcgctacagcaaaacggacaaggggatgtattgatatgggcagttacactgaacgcgcgcttgctctccataaagagggttgtaattgtgcgcaggcggtactttgcgccttcagcccacggtttggccttgatgaacggacagctttccgcatttcggagggctttggcggcggaataggtggatcgcatgacaatgtctgcggggcggcggcagccatttatatgcttgcaggcttgaaaaacagcagcggagcggccgcggacggcctgacgaaaaaggatacatatgcacgggttcgttccttgtccgaagcctttgcggaggagaatggaagcaatatttgcagagagcttctggagttgaatggccaacgcaagctgacctgtgcggaccgcgtggcaagtgcatgcaggattgttgagcggcttttgttggacgagcttgtatgaacgcgtacaaatgcacgctctgtccgcgccgatgcggtgcggacaggacgcggacgacaggtttctgcggcggcgcaaaccatgtccgcgcagcgcgcgcagccctgcatacttgggaggaaccgtgcatcagcggcacgtgcggttcgggaaccgtatttttttccggctgcgcactgcaatgctgtttttgtcaaaattatgagatcagcgccggaaattttgggaaagaattgacggtgcagcagctagcggatgtttttctttcgctccagaagcagggcgcgcacaatatcaatctggtcaatccgacacattatgctccctgggtggcgcaggctgtacgtctggcgcgtccgcgtctgcaaattccggttgtatgtaatacaggcggctacgaatcgatggagacgctgcgcgcgctggaaggcgtggtcgatgtttacctgcccgattttaagtatgtcgacgcgcgccgcagcgcgcgttattcaggggcgtccaattattttaaaacagtatcggccgctttgccggagatgctccgccaagtgggggctgtcaaaatggacgcaaatggggtgctgcaaaagggtttgttgatccgtcatctcgtactgcctaagggagtgggagattcgatcgccgttctggaatggattgcgtcaaatttgccacgaaatgaagttttaatcagcctgatggctcaatatacaccgtcgtatcacagcgcgcggtatccagaaattgaccggcgcgtcagcacctatgagtataatcgtgttttgcagcgtgcgcgggagcttgggctcgacgggtatatgcaggaacgcgcttccgcattcgcggaatttacgccgtcgttccgattggaggggctttgatcactctgatcccgatgaataactcaggctgcatggacccggcggtgtgtggctgggtgtgcgacaagcctgttggcgcggctggatttgcgcgggtgatatgtggcggtacgctttgggcggccgcctttttttgcgcagaaaagcgcgcatccaccgaaaaataggagctggaacgccagttcggggaagctgatgccgccggtttcccatgctccgagcgagccgataatcaaaaagacagagatgatggaaagcagttgatacagttgacgcgcgcagtatagcagcttcatatgagtaaccttctttctcgttgtcaaatatggttgttgtatttactataatacaactaaatgtagttgtcaagcgataatttaacaactttttttaaaaatatggattgacatagacaacagataattgtatactaaaagaaataaaatggatggaggatacagaatgttttcagaacgtctgaaggcccttcggaaggaatgcggaatttcgcagcgcgcgctggcgcagcgccttggcgtcagccagcaggcggtagcgaagtgggaggccgcaagttcgacgccggggccgaacgcgctggcgacaattgccgatgtgctgggcgtatcttccgattacctgctcgggcgtgaacgcgattttcaagacggcgcgcaggacacggcgcggctgccggtgcttgggaccgtcaaagctggttatggggcctatgcatttgaggaggattacgggaccgcgcctgcgcaggtgcgtgatccaagggattatttttatttgattgtgcgcggggacagcatggagccgcgtatccacagcggcgatctggcgcttgtgcaccggcagccagatgttgaaagcggcgagttggcggttgtgcttgttgcgggtgaggaggggacgctcaagcgcgtgattaaaaaggagggagcggtcatccttcagccgtttaatcaggcgtatcagccgcaggttttcatcggagaggagcttgaacaactcgtcatcattggaaaggttgttgagacaaaaacccggtggtgagttgcttttcccgccgacatatggtaaactgtcaccatgcaagggtttggaaactgtatgaaagagggaacagccgtgaacatttggcatgatatttcaccaaaacgtatatcaaaaaacgattttatcgccgtcattgagatcggcaagggcggcaaaaacaaatatgagcttgataaggaaacgggcttgatcatcctggaccgtatcctgtacacatcaacgcattatccggctaactatggttttattccgcgtacctacggcgacgataacgacccgcttgatgtgcttgtgctgtgttcagaatccttaattcccctgagtcttgtgcgctgctatccgatcggtgtgatctccatgattgataatgggaagaacgatgaaaagattattgcgattcccttcaacgatccaatgtacaatatgtataagagcatcgacgaacttcctgtgcatatttttgaggagatgcgtcatttcttttcggtttataaagagctggaggggaagcagacggccgttaacgatacggctggcccagaagccgctttggaaattgtccaggcggccattgataattacgtcgaaaagttttgcagggcctgagaaactgcataagaaccggagtaaccacggttttttcaagcaggctttgaagcggattggaaaaggccgcccgatttttcgggcggccttttccgcgcgtgcctattttatgatgcaatgacatattctgttaccattggaggtgacggatatgcagacgcttgcgcttgcgggaaatccaaattgcggcaagacgacgctgtttaataaactgacgggcgcccatcagcatgttggaaactgggccggggttacggtcgagcgccgggaagggattgtgcgcggcagcagtgcacgcttggttgatctgccggggctttattcgcttgcagcctttacgctggaggagcaggtgacacgcgaatttcttcttgacggttcgtatgacgcggtgataaacttgctggacggaacatctctggaacgcggcctttatttgacactccagttatgcgagcttggatgtccgatggccgttggaatcgggatgatggacgaggtacgcgcgctgggcggtgcgattgactgtgacgtgctggcacatatactcggtgtaccggtggtccctgttgcggcacgcagcggggagggagtcggcctgttggccgaagcggcgcgcgctggggcgcgcgccggcctgccgccgcgctatggcgcggcggcagaagcggcgattgccgcagtcgcctgtgtgatctcagagcatatccgccggcctgagcagctgaggttttatgcggttggactgctcgaaaatatgaagcttgccgattcgcttgggcttacaaaaatacagcgccggcacatcgacaggatcagaagcgaatttgaacagcggtgtggggttgatgcggccgcatttctggcgcaggcgcgttatgatgctgtcgatgctattgtgcggcaggcagccggacatgccgcgaagcggccgcatacctggtccgacagattcgatacgttggcgctcaaccgttttctggcgtttccgatctttgcggctgtcgtatccatgatctttacaatctgctttggcggcatgggtcttgccatgaagcgcgctgccgagcaattttttgtacaggcagcggattttctgcgcagggcgctgcctgaacttggtgtatcaagtttttggatcgggcttgcggccgacggcgtggtcggcggcgtcggcagtgtgcttgcctttttgccgcaggttgccttgatctttttgtgcctcaccatattggaggaatgtggatatctggcgcgggcagcttttttgatggactatttcctgcggaggatcggattgacgggcaaatcctttattccgcttttgatgggatttggctgtacaacatcggctgttatggcggcgcgcacgctgggcagcgaccgggaccgacgcatgaccatccttttgacaccctatctgtcgtgcagcgcgcggctgccaatctatgtgttgctgacaggcgtattctttccatcgcatcagggtgcggcggtggcgatgctctatttgcttgggatcgcggcagcctgcgctgtgggtttctggctgcgcacaggtccctacaggacatacagcgcgccatatctgatggaattgccgccgtatcgtgtgccgtcgctgcggaatgtattgcacagcacattctctaaatgcggcgattttttgcgtaaggctgggacattaatatttttattgagcgtcttgatctggatgatgcagcatatcaatctgcatttgctatggaccgcagacgcattacagagtatatttaccgctgtcggaaacgcactcgcaccgctttttcggcctctcggctttggaaatggaaaggcggctgtcgcgttgctggcgggactggtgtcaaaggaagccgttgtttcgtcgcttggcgtggcgtgcgccggcgcacattcttttgaaacggcgctcacagagctgttcactccgctttcagcggcgtcgtttttaaccttttgcgctctttatgcgccgtgtgtttctgcattggcgacaatgcgccgcgagctgcactccatcaaaacgacagtgatcgccgctgtttcacagatattggttgcatatggagctgccttggccgtctatcaaatcggcttgttgtgtcaaagagtgctgtccagttttccgtagcctgcctcgctgtcctttaaaaaatgtgccgcaatctataaaaatgaaagaaattaaaaaaatcctgcaaaaagcgattgcaccggcggaaagtacgcgctatactgaaatacagcggtttagggtttgattgaaaatagagaaattagcccttggactttccaatgacggaggacggattatgaaagtaaaattgatggtacagattgcaattgtattcggcgtttgcctgctcggagaggcagtggcgcaatatatgccggttccgttcccggcaagcgtgacagcgatgctcctgctgctcgttctgctgctggcgggcctgctgcgtgtcgagcatgtacaagaaaaaacggactttctgctgaaaaacatgccgttcttttttatcccggcaagtgtgggcgttatggaatattttgatgttctgcggcgttgtctgctgccgctgcttgccgtttgcttcatcaccacgattgcaaccttttttgccactagcttcaccgtgcgcgcggtatcctgcttgcagcggcggctgacgcgccgcggggaggcggaatgatgaaggcggttctggaatccccgctgtttgggatcgttttgagcatccttgcatatgaagccgggctatgggtcaaccggaagctgaaaacgccgctggctaatcccctgctgattgcagtcaccttgattgtcgggctgatgatgctgtttcatatcccgctggaaagctatcaaaaaggcggcgacttgattgccttattcctggctcctgccacagcgtcgcttgccttgtcagtctacaatcaacgcgggatactcggtaaaaacctgctgccggtgattgctggatgcgcggtgggttcggctgtttcgatgggcagcgtttatgcgctttgccgtttatttaagctcgacgaagccgtgactgcttcgttgatcccaaaatctgttacgacgccgatcgccacggagatttccgcgcagcacggcggcattgtcccggtgacagtcgcagctgtgatcattacaggtatgatcggcgcggttctggcgccgtatatgatccgtatgttccatgtcagaaatccggttgcggacggtctggcaatcggtgcgtcaagccatgcgctcggcacaagccgggcgctggaaatgggagagctggagggcgcaatgagtgggatcgctgtcggcgtttcagggcttttgacagttttattttcccttgtacttggctgaaaaagccatccagacgtgaataaagcggcgtccccttaagggacgccgctttgctttttcttattttgcatattcgattgcgcggttttcccggatacagtgcaccttaatctgaccgggataatcgaggtcgctctcgatttttttcacaatatcgcgtgcaacaatggtcatttggtcatcagagacgacatcaggcttgagcatgatacggatttcacggcccgcctgaatcgcaaaacacttatccacgccgtcaaacgagttggcgatctcctcaagcttctcaaggcgcttgatgtaattttcgaggttttcacgccgtgcgccgggccgtgccgccgatatggcgtcggcggcctgtacaagacaagccacgattgttttgggttcaacgtcgttgtgatgggcctcgatcgcatgaatgatgtcggcgttttctttgtacttgcgggccagatcgacaccgatctggacatgggagccttcgatttcatgtgtcatcgacttgccaatatcgtggatcaggccagcgcggcgcgcctgcgcttcatccgcgccaagctcggcggccatcatgccggcaagctgtgaaacctcgatcgaatggctaagtacgttctgtccatagctggagcggtaacgcatccggccaagcagacggattaactccggatgcataccatggacgccgcactccataacggcgcgctcgccgtcctgcttgatcttgccctcgatctcgcgccgcgccttttcaacggtttcctcgatgcgcgcaggatggatgcgtccgtcctgaatcaggcgttcgagcgcgacacgcgcaatttcacgtttgacggcgtcatggctggaaagcgtgatggcctccggcgtatcgtcaatgatcaggtcaacgccggtaagcgtttcgagtgtgcggatgttgcggccctcgcgcccgatgatccggcccttcatctcgtcgctcggcagcggaacgaccgacaccgtaatttccgcaacataatccgcggcgcagcggccgacggctgccgcgatgatctcctttgcgcgctggtcggcttcatccttgagctggctctcatattgattgatccgcagcgccttttcgtgcgtcagttcaccctcaagattggcaagcaggtaatttttagcctgatcggccgtaaagccggagattctttcaagcatttcaaactggcgcgccttgacatcctcggcctcctgcagcttgacatcggcctcgcgcagcttgttttgaagcgtctcctcctttttttcaaggttgtcgagctttttgtcgacagactcctccttttgctgaattcggcgctcaaggcgggaaacctccgaccggcgttccttcatttccttttcattatcctgcttaagcttgtagatatcgtcctttgcctcaatgatcgcttcctttttcttggtttcagccgacttgatcgcatcgctgatcagacgctttgcctcctcctcggcagatccaagcgccgcctcggccgattttttgcggtattccacacccagaaaaaaagcaatgacagcacccaccaaaaaggagatgatgatgccaatgacaaagggaatgattccgattgtgctcatttgggaacaggccctcctttatgcaattttcaatgtccgcaacccgccctgcaaaaccaaaaagcccggccgcgcgggcatagggatacgcaaagcggatagaatatttatcaggtaggcggtttgattcacgtaaaatttacgaataattcaaagctgcgttaccgttaaacatactgcatgacaatacttattttatatgtattttgtataattgtcaagaaatattgtgtatttaagcgggttatcctatctaatatgcgcggattgatacggcgtgggcgaattgacagttgacaggccgccgcggccgtgctaagatgaaaaaaagtctgatatcacctaaaggcaatgacggggaacacaaccaaagtacagcctgttcacagagaggcgcggcgcctgctgaaagccgcgccgtccggtttttggcggcgaccgccccctgagcgcgcgcgatgagcgcgccggctgatcccgttaaagatcgcttgagcggcgcgtttgcgcaattcgggtggaaccgtggagcctgccttcatcccgttgtgggatggggcttttttattttgattttcgccgtaggctcattggagccggttgataaaatctcctcactcaaaacagcggcgctttattccggcatatttacaaaaaaagtttgtgaattcacggaggcttgcctgtgttttttgttttatctgccgaaaaaatcgttcttgtttttggcgcggcttggtttgtcaacaaatcccatttgaccggtctgtttttcgcagagaaaggatgctgaaatgatgataaatgtaacgttaaaagatggcgttgtcaagcagtacgagcagggcacgacagccgcggaggttgcaaagagccttggcgcgggactttataaagccgcctgcgccgcaaaggtggacggcaaagccgtcgacctgcgcacgccgctggagagcgactgtacgctttcgatcctgacctttgatgcacccgagggcaagcacgcgttttggcacacggcttcgcatgtgttggcacaggctgtcatgcgcctgtatcccgatacaaagtacacgattggaccggctgttgaaaacggcttctattacgatttcgacgtcgaaaagccctttacgcccgaggatctggccgctattgaaaaggagatggcagccattgtgaaatcaggcgtggagcttgaccgcttcgagcttgacgcgccgcaggcgcgcgagctgatgaaggaccagccgtacaagctcgagctgatcgataagcatgcggcaagcggcgagaaggtcagcttttaccgtcagaacgatttcaccgacctctgcgccggtccgcatctgatgaacgtcgcgccgctcaaggcaatcaagctgctccaaagcacaggcgcctattggcatggcgacagcagcaacaagatgctctgccgcgtatacggcattgccttccccaaggcgagcgagttaagcgactatctgcacatgctcgaggaggccaagcgccgcgaccaccgcaagcttgggcgagagcttgatctatttgatatctatgaggaagggcctggtttcccattcttcttccccaaaggcatgatcctgcgcaatctcctggagagcttctggcgcgaggagcatcaaaagcacggttatcaggagatccgcacgccgctcatcctcaatgaggagctgtggcaccgctccggtcactgggatcattataaggacaatatgtatacgacgaagattgacgaccgtgactatgcgatcaagccgatgaactgtccgggcggtattctggtctataagcgccgcatgaattcctaccgcgatctgccgcagcgtcttgcggagcttggcattgtgcaccggcatgagctttccggcgcgctgcacggtctgatgcgtgtgcgctgcttcacccaggatgacgcgcatatctttatgacgcccgatcagattgaggcggaagttctcggcgttatcaatctgatcgacagcatctacagggtgtttggcttcgactatttcctggagctgtccacgcgtccggaggattcgatggggagcgaggagcagtgggagacggctacggccgccctgcgcaaagccctggaggacaacggcaggccgtacacagtcaacgagggcgacggcgcgttttatggccccaagatcgattttcacctgcgcgattctatcggacgcacctggcagtgcggtacgattcagcttgatttccagatgccggaacggtttgatctggcctatatcggcagcgacggcgaacgccatcgcccagtcatggtgcaccgcaccgcatttggaagcatcgaacgctttatcggtatcctgattgagcattatgccggcgcgttcccgttgtggctcgcacccgtgcagatcaaagtgctgccggtaacggacgagcatatcccttatgcgcagagcgtagccgataccttgacaagggccggcctgcgcatcgagctggacagccgcaatgaaaaggtgggctaccgtatccgtgaagcgcagctccagaagataccgtatatgctggtgctcggcggcaaggaggctgaaagcggcgaagtcgcagtgcgtgaccgccgcgatggcaagacgacgacgatgctgttggcggactttgtggagaagatgaaaacagaggtcgagacaaaggcgaactaaatcgtttgaccgtgcgtggagggcgttttgaagcgccttccgcgctttttttgttccggaggaaacaaaatattcatattgtgtcgaaaatttcgccatataattcgtgtttactatacaaatacggagtcttgtcggcttcctgcgcgccttttaatcggtccagggccgattggacttgccattgtgcgcgtttcacggtataataaccgcagagcggttattataccgtcttatgcccaacggctcgccgcttacgcggcaaccgccttctgatgggcaattataccataccgcttcgcggacatggtataataaccgcagagcggttattataccgaggttatggccaaggcgatacgcgggcgcggcccgcttccgccatgatggccaattataccatgccgcttcgcggacatggtataataaccgcagagcggttattataccgaggttatggccaaggcgatacgcgggcgcggcccgcttccgccatgatggccaattataccatgccgcttcgcggacatggtataataaccgccttatggctagggcgatgacgccgtactgctttttggataatttgaaaacgatcactgatggaatggacgccgcagctttcaaggcggcgatttgatagaagccggcgcaatcggccggaattgatgcggaaaggagatgatgtgcttgtcgagacgcaagcggcgtcgcggcgcggataatcgcgcgcaggatggcgcgccggagcagaacgcgccaaacaagcagacagaacaggcacaggattccgcacgaccgcctgcaaatgctgaacaggcggcagattctcaattgcacattgaaccgccggtacaggaattgtccaaggcggtttcggatatacagtcgaatgagaaaacctccgacgcggccgatacgcctgccggtgagacagaaaaggccggcagtacagccggtacgcctgacggtcagaagaaagcgtccgccggcgaggacgaaaaaatattggaaaagcccgtatggatggaaaggccgcagcgggagccaggtccatttgtacgcgcggtacataatttatttgcccgctgtgtaaatgcggtttatgactatggctattttgtcggtattcagttattgcgttccacgcgcggcaagcgccgccgtctggttcacagcatgcgttcctggcgcgaggcggcagcggcgcggcgggcgaaaaaaacctttcgtttccggcgctacatgcgcaaaagctggaatgagctgattgcgccgtttaccgagctgcgcgcccattaccgcgattatctcaaggctttgagcaatgcgcggcgctatggaaccacctctgagacatcggcgatttattttagaattgccggctttaccttcagccggctgtggcgaattcttaaaacgctgctcaattatgcggcgcccatcgcggcctgcgtggtatgtgtgctgaccatccagtattttaccggccgcacgctggctttgcgtgtggaatataacgggatcgatctcggttatatcagcagcgaatccgtttttacccaggccgaaaatgatatgaaggcacgcatgcgtttggacgatgtgcttgtagccgacccaacacagcaggattttgcagcgcagggacagcaaacacaaaacgcgcagatgcaggcgaacctgattcgtccggtctatcagatggaggctgtgcgtgaggaggagccaaccgcgttgtatgcgtgggtggacaggcttcttggcgtgccgcgcgtagagctttccgatgcggatacgctcacgaaccggatgattcaagcggtcagcaaaagtgagaacaaccctgacggctttgctgttgaggaggcggccggactgtacatcgacggcacctacatcggcgcggtcaaggacggccgcgcactgctccagctcctttacgatatgcaggagcaataccgggaaccgggcgatgaggatgcggatatcagctttgtaaagaaaattcaaatccgtgagggcctgtatccgtccggagaatcaggttcgattcgtcctcttgaggagatcgaggagatcttaaacaaggaggagcgcggcaaaaagatgtatacggttatcgagggcgatactccgatcatcattgccgccaaaaacggcatctccctggaggatctgatcgcgatgaacccggatgttgaaacaagcctgttcccgggcgatgagcttttgatcgccaactctgtgccgtatcttggcgtgaaggtgacaaagaccatccgctatgaggaagatatcgaatataccataacgcaggaaacaaacccggaggaaaatattggatatacgcatacaattcagaagggcgaaaagggcctgcgcgaggttaccgctgaaattgtgatgattgacggcattgagacggagcgcaatattacaaaccgcactgtgattaaggagcctgtcaaccagattattgaggtcggcggcaacaagccgctcatgaccattccgcgcgacagcactggaacaaccgcgcccggcgcatgggcttggccgaccgttgcaggctctattaatccaggcttccgcggttattggggacacaccggttccgatatttcctggagcggctgctacggctcgccggcgctcgcttcggcagacggcaccgtcgtggccgccggatggggcggtgcgtatggttatcgtgtcattatcgaccacggtggcgggtatcagacggtgtacgcgcattgcagcgcgctgtatgtacaggctggccagcaagtcagccagggcgacacaatcgctgcaatcggtcagacgggcaatgcgacagggccgcacctgcattttgaaatccgtatcaacggtacgcccgtcgacgcagcgccgtatctttacagctaaaaatcagctttgtttgattcccacaatggaaaatcaaaacagaagcggtacaagacagcttgcttcggccgccccggatgaggctttcatccggggcggctgctttttttgcagaaaaattgaccatttgagatgattcgcagttaaaaaggatttcgaagaaaaatacaaaaattgctcttttatttccatgatatcggtggtataatatacatgctgtaatgcgcaggtcgctgcgcgttttttctgtcttttgaaatcggaattgctgcgtcccggttcaccgcgcagaaaggcggggcgttttacaaataattggattgacaggcgcggagaaaaggcggtcgtgttggaacagtttattgttcagggtgaaacacatctcaatggcgaagtcacaatcagcggggcaaaaaacgctgctgttgcaattattcccgcaacaattttggcacagggcaagtgtgtgattgagaacatccccaatatcagcgatatcaaggtactttttcaaattctgcgggcgcttggcgcgtcggtgcagatgcttgaccggactactgtggagatcgacacaacacatattgtcgagccggttgtcccctatgagcttgcgcggtatatgcgcgcctcttactatctgctcggtgcgcttttggcgcgctgtaatcgtgcaagcgtatccatgccgggcggctgcaattttggtgtccggccgatcgatcagcatatgaaaggctttgaggcgcttggtgctgatgtttcgatcgacagcggcatgatcaacgcgcgcgccgacctgttattgggcgcacatatctattttgatgtcgtttctgttggcgcaaccatcaatgtgatgcttgcctctgtcaaggccaagggcatcaccatccttgaaaactgcgctaaggagccgcatattgtcgatctggccaattttctgaattcaatgggcgccgatatccgcggagcgggcacggatgttatcaaaattcacggcgtcgatattttacatggaacaacgtatcccattattcccgaccagatcgaggcgggcacctatatggttgcggccgctgcgaccggcggcgatgttctggtgcgcaatgtgatccccaaacatctggaggctatcacggagaaattggaaaaagccggagcgaccgtgattgaatacgacgattccatccgtgtaacgcgcacaggtcctctgagtaaggttaaccttaaaaccatgccgcatcccggctttccaactgatatgcagccgcagatgacggcgctgctttcgattgcaaacgggacaagcattgttacagaaggcgtgtgggacaaccgtttccgctatgtcgacgagctgcgccgcctgggcgcgcagatccaggtggatggaaaggttgcggttgttgagggtgtgacgcagcttgcggcggctcctgtgcgtgcggttgacctgcgcgccggcgcggcggtgctgattgcggcgatgactgcacgcggcgttacagaaattgaggatatcgagcatattgagcgcggatatgaaaatattgtggagaagctgaccggcctgggggcggatatacgaaaggttatcattccagataacgagcttcaggcggcgttataatgtaagcgcggcgcggcctgcataaacgcagaatccgccccgctgttcgcggcgcagcctgtataaacgcagcgcccgccccactgttcgcggcgcagccggttaaagttttttgccaagctttttttcaaaaaagcgggaaggaggagtatggcaaggttttgtccgctgttttcgggttcgagcggaaacagcgtttatatcgcttcatcagattcggcggtgctggttgacgcggggcgttcctgtaagcagctgatggctgccatggacgcgcggggaatcgacccgcgcgcgttgttggcggtgctagtcacgcatgagcataccgaccatatcagcggattgcgcgtgctgcttaaaaagctccgaattcccctgtatgcaacagccgaggtgcttgaaaggctgcggtgggacggcgtaatcgcacctgatcaggaggcgttcactgtggaagcaggccggccgttttcggttggatcgctggtaatcgacggctttgatacgccgcatgacagcgtacacagcgtcggataccgggtgcagacgcccgacggtcgccgtgtggcggttgcaaccgacatgggatacataagcgatggagtcgcctctgtgctgacaggctgcgatcttgttatgatcgaatcgaattatgagtctggaatgctcagcgtatgcgattatccttattatctcaagcgccgaattgcttcaaacctgggacacctttccaacgatggatgcgccaaggaattgacacgccttgtacgcaccggaagcacgcgctttatattgggacacctgtcggaaaacagcaatacgccggaaatggcctatcaatccgcgcttaccgcgctgacacaatgcggaatgcatgaggggcgtgactttcttttgcaggtggcccggcggtccgctccgtctgaaatggtgaccttatgattggactgcatatcgtggcggttggtaagctcaaggaagcatggatgcgcgaagggtgcgcggaatataccaagcgcttgggactatggagcagcgtggccgttacggagatcgacgaggcgcgtttgggcagcgatccatctccagcggagatcgccgcttgcattgaaaaagagggcgcgcggattcttgagaaaatcccgcgtggtgcacgtgtggtcgcgctgtgtatcgagggcagacagatgccttccgaggcgctcgctgcatatttgtcggacgccgctgcgggcggatgcgggtcgtttgcatttgtaatcggcggttcgcatgggctttctgatgaagttaaacgtgcggcggctttgcgtctgtccatatcgcccatgacatttccacatcaattggcaaggctattgctgcttgaacagctttaccgcgcctgtgcgatcaatgccggaacaaaatatcacaagtaacggcaatgtccgcgaaagcatcggctttctgcgggcgttgttcatttctgcttctgcgcttgcaggatggattggaggctttttccatgtggccggttgaagcggcgcaaatggtagagctgttcagggtccccggtgatgtagttgagcttttcctcgcaggtcaaagcagcctgaaagcccatgtccttgaggattggcagcgtgtcggagctgatctgtccaaatggataggtgaagcaggtgggcgtccagccaaggttttccttgcattcctgttggagcttgccgagatcttcaacgatcagatcgcggtaaagcgcgaggttttccccgggcttgcgttttgcgccgtggcgcgcgccgtcattgtggtgcagatcataggagtggttttgaatttccacaagaccgctgtcgtgcatggcctttaattcattccatgtggaatgggagtaacggatgtggtggtcgtcaatttgggaatactggtcggcatatgttccaacaatggagtagacggccttatactgatattcctgtaaaatgggatagacatactcatgaaagctttcatagccgtcgtcaaatgtgatcatgacgggtttttccggcaggggggcgccgtcctggacatagttgatcaaatcctgaatcacaatcggcgagtagccgcaatctttgagatactgcatatccatacgaaattcatctggggagatggtgaattgattcaagcgccccgcttccttgagcacatgatgatacatgacgattggcagttcaatgccatccggagcagccgcatttgcgggaatgctgcgtgcaagatgcgcggcgacgcctcctgccgcgacggcaaaggcaagcgcgacgggcagcagcagcttatcaatgattttcatgcgcatttccttcctgtgtagtctggataaattgtctattcaggatatcattggcttggtatcctgaataggttctctgtattttatgcggggcgcgcctgtccttatgtgacggacagaactgggaaaagagtgtgtgtacgcattgggtggaaatgtggtataataaccgcagagcggttattataccggggttatgcccaacggctcgccgcttgcgcggcaaccgccttttgatgggcaattataccgtgccgcttcgcggacatggtataatatgcgcagtgcaaacggctttgccgtttgcggccgccatccggcggctgccgctgcaaagcagcggactgcgcatgttacaccacagccaaaaccagctccgctggtttagctgccgctttgcggcaggcaagcccgaatgggcttgccgctgtgatataataaccgcagagcggttattatacacttatggccaaggcgatacgcgggcgatggcccgcttccgccctaatggccgattataccatgccgctttacttaatgtctggggcggcgcgccatgctgatggctaaagtgatgacgccatatcgctttgaaattaatcgctgcggccatgcaatctccactgcatggtgcaattcaggaaaaaaggatattgaaaaaatttatgaaatttgaagaacttgggctgattcagcccattctgcgtgcggtacgtgacgaaggatatgtggagccgtctgcaattcagcagcaggcgatcccgcccgcgctcgcaggacatgacgttttgggctgcgcccaaacaggcacaggcaaaacagccgcctttgcgatcccgattttacagagattggatacacagtgcgccagtataaaaacgccgtgtgtaatccgtgcgctggtgctcacgccaacacgcgagctggcgattcaaatcaaagacagctttcaatcctatggccggtatatgcgtttgcgttccaccgtagtattcggcggcgtgccgcagacgcctcaggtcgatgagctgcgccgcggcgtggatatccttgtcgctacgcctggacgcttaaacgatttgatcgggcagggaatcatagacctttcctccgtgagcgtctttgtgcttgatgaagctgaccgtatgcttgatatgggctttattcatgatgtggaacgtgtgattaaccatttgccgaataagcgtcaaacgttgtttttttccgctacaatgccaaaagcaatcatgcatttgtgcgaccggattctgacagatccggtcaaggttgcggtcacaccggtttcctcgccggtcgaagcgatcgagcagcgcctttactttgtggataagccaaataagcgccggctgctgatttatctgctggaagatgtctcaattgtatcggcgcttgtatttacctttacaaagcatggtgcggaccgtgtcgcgcgcgagcttgtaaaagctggaatcaaagcacaggcgatccatggggacaaaagccagggcgcacgtcagcgtgcgctgtctgcatttaaaaatggcgatatccgcgtactggtggccacagatatcgctgcgcgcggcattgacattgacgaattgtcgcacgtgttcaattatgatctgccgaatattccagagacatatgtacatcggattggccggaccggccgcgcagggcttggcggtatagcgatttcattttgcagtattgtggagatggagaatctgcatgcgattgaaaaactgattggaagaaagattccggtggtcaaggagaatccatatccaatgcaggtttttgaggccccgcccaaggagccgcggccgccgcgccccgcacgtgcagcgcgcggcgagtcgcgcgcgcatatgtccaagccggggccggcacgcccgaaagccgcccggcgcggcaagaaataaagaatagctgccttgatgccattcttttgcgcaactgtttgcagagcggttttgtgcttcaatatattttgtccggcgcatgtcctgacaaaaatggtttttggcagcggcagggtaccgctgtgtctggcagactttttcgatggtctgtctttactgcatatttatctgctgatccatattatgctgcaatttctcgctgtagctttccggctttaaccattgcttgaatcctgggctgcaaaacctggacttgttcatattttttagacataatactaccccctgatgtacttttattatcatacatcagggggctttttgtctattgtccaattttgctggttcggttcataagcaagctgccgggcttttttgctgtgcgaaattatgccgccgccagacgcacggctccttccgcctgctcgagcgcctcgcttccgctgtcattaagataattgatgacagcttcatccagcgcacagaattcattgaccaccggcttattgagcatggtgtaatcgtccccgccgaccgacatgaaatcattggttgcaacaagataggtttgtgtttcagaaaggggcttgccgttgaccgtgatggaaaggatacggcttccttgtggacgcgccgggtcatacgaaacctccataccggcaaactggctcatgcgtccaagctgctcaagcgttccgtctgcctgatagcccggcagcccgtgctcaacggctgcacgcaggtccttgccggtgagcttgatggttacgatgtagttgccaaagggcagaacattctgaacctcgcccacggtgatgggtccctgatcgatcgacgcgcggattccgccgccattggtcaacgccacatccgcgccggtttcagcaagcatcgcgctggtgatcagacgggaaaggttggtttcaccggtacgtacatgggcgcgctcgccgtccagagcgacaggcgtggttgcgaccacctggccaagcttgctttcctggccttttttgatcgcatcgattttagcctggaccgccgcgtcgggcgcaatttcatccgccgtataatccgaagccttcaaagggttggattcgacagtaactgtcccgtcaggggcaaccgtaatgtccaccatgcccaggtaggccatatactccccgcaacttacgatcacagtgccgttgaccggctgatactcattgggcgtggaatggctgtgtccgtcgatgatcagatcaatcccatcgactttggcagccacattggtgctgaccgcagtcccgctctcctgatcgatcccaagatgagcaatgcagataatgacatctgcgccccgttcttcaagcgcctggacctgttttttcgcagtggaaacaggatcggcaaatttgacctgcttcacattcaaagggttggttttataagcggtttccggtgtggaaaggccaaaaacaccgatcttcacatcgccaacgcggtacattttgtttgcagtgaagccttttaaaactgtaccggtgtccttattcagcacattggcgccaagcagggttgcgcccgcgtagcgtgcgagcgtcggagtacgggacgcgccgtaattaaaatcgtgattgcccgcaactacggcgtcgtacccaaccacatccataagctgagcgatactcaggccgcggttgagggtcgcgaacggctggccgtggaaggtatcgccggcatcgaaaaccagcgttttatccacgccctgggaataggtatcaacgagcgttttcattcgcgcgtatccaaatcccgaaagcgttccgtcatcattcactgacgcatcataccttgaatgaacgtcgttggtatggaaaatccggatttgggtatcttcctgcgcagggacggcaaacacacccaatgaaagggttcccgctgtcagcagcgccgcagtaaagcctgcaaacaggcgggtcagtttggagcgattcatacttgcacctcttttttctttctgtagtttggcggaaaattgtaccgcttgtcctccattatacaatatttatttcacaaaatccacatatttcctgaggtgtaaagtgatttttatgtaatttttttgttagcggcaagtgaaacgcaaactcaataaagcgtatgaagtaaaataatgatccagtatccgattgaaaaatgagtaagatctatacagtcttacaaactggcgctactgaagcccgccggttcaagactgccgccttttgtcactgggtcgatgtatgaaaaattgatttggctccaatcgatgggaatagcgattctgcccaaaagagcgattttaatttagtgaattacacaaattttttataaaaatctttgtgaaaatcgtcttttcaagaaataaaagtagcattttcaataaaaaaacaggattccggcatacatatttgctaaattgtcagaattttaacgaatagttttgtagatatcgcacgcgttttttgcataatttacataaaataaatttaaaacagggtaaaatcaggtgaatttgacagtaaagcacggcgatgctatattgaatgtgccaattttcagatcaggcgctccgggcgagcagctcgggacgattgatcaataaaccgcttaaccaatcaaggagaaggagctgtaacactatgaaaaaagcaatttcttgcctcactgccctgacagtatgcgcagccgcccttgccggatgctccagcggcgcgtccccggccggacagggcgccatcctgaacttcggtacgggagcggtgggcggtacggataacacggttgtggaagccatctcctctgtagtgaaccagaataccagcctgcgcacctccaccgtgaccaccaacggcggcgcggagatcatttacctgttggaaaccggcgacatccaggcgggttatgccggcaccatcgacctggtgaacgctctggaaggggcggggacctttgaccacgcggtcgattcctctcatatgttgcaatgctttgggttcgtcacctgggcgctgcccatggtggtcttagaggattcctcgattcattcctacgaggacctggcaggcaagcgggtaggattatccccggttggctcctccaccgccgatgtcttaaacctggtattcgaagcttacggcctgtctgactccattacagtggaaaactttacttggagcgagggatataccgccctcaaggacggccgtatcgacgccatggtaggttcctgggccaatggggacccgatcagcgggctgatcgagctgaaggcgacgcaggggatccgcattctgaatatggacgaggcgatcgcaaaaaaggtagccgactccaacgagggcgtcggcacggggacgctgacttttgaaaatgacgattccatcccgcaggaggatacgatcctggctcccgccaactccggcgttatcatagcggatgccagcgtggatgaggagtccatctatcagtacaccaaggcagtgctcgaacatctcgacgacttaaaggcgctttctgtttatttcaatgattttgagactgtctgtaccagcgtatgtgtggaaagccttcccttccatcccggcgcggcgaaggcccttcgggaagccggcctgtgggaggaccggtttaccgtttatgagggctgaagcaggcccggatacaggacgatttaaaagactgccgggggcgcagcggcgctcccttccttaaaagaacagaaaaaggaggatctatggaagaaagcaaaaaaacaggttttgacctgaaactggacagggccatctcgattgtggccattgtcatgagcgcctaccatctgatcgcctgcaactataacattttccaggcgggccagcatatcaacctgcatatcctgttctcactgatcatcgtatttctccaggccgtcaagatcaaaaacggcaaacccacctggcagagctggtgcatgatcgccctgctggcggccagcgttgtcacctgcctttacatccattttcactactacaactttatgaccgccctgggggcgcagccgtttgacaaggtgttcagcggtgtgtgcatcctgctgatcatcctcatcgctacgcagcgcacatgggggtgggttatcccggtgatctccataatcgcgctgctgtatggctattttggaccctggctgcccaatcccttcttccatggggggcttcctttctcaaggctgatcacctatgtcaccaccaacttcgacggggtttacgggatgctcgcctcggtttcggccaatacgattatcctgttcaccatcttcggcggtctgatggacgcctttggagcgatcggcgccattatgaatgtggccatgtccgccagcaccaaaattcgttccggcggcgcccaggtggcggttgtttcggcgggcctgatcggctccatcaccggcagcgtggccgccaacattaccctcaccggttcggtgtgtatgccgctgatgcgcaagcgcggttattccgccgaatttaccgcggctactgaagcggcggcatccacaggcggcgctatcctaccgccagtcatgaacgccgcagcctttatcatcgccagttggacaggcatcccctatattacgctcgtattcgtgggcgtcaccccggccttgctctattatctgggtatctccctgagcgtctacatcaaagcctgcaagcttggggatgagaagatgaaaaaggagctgctcccgcagttccaccacgcctatgtcaacctgatggtatttttgatcccgctggtgctgctggtgaccctgatgattatgggcgaatccccccagaaggctctttccatggctatcctcgggctggccgtggttgggctgctccagcagttcatcatccgggaagccaatcccatccgatcctttgcgaaaaagttcgtggcaggtctggaaaatggaggccgcacggtggccagcatcgccgtggtcatggcctgcatgggcgttgtggtccagatgatgaccgctaccggcctttccagcaagatcagccagtttgccctgtccattgccggggacaacctgatcatcctggccctggtggtagctttgacctgcactttgttcggcatggggatgccgagcgcctccgcctacatcctggcggcgcttttgggtgcgcccgctctggtttccttcggcgtgccgcttgtggtagcccatttcttcgtcttttactttgccgagatgagcgccctgacacctccggtcgccatcggctgcctggtggcctccggccttgccaacgccaagttcctaaagacatgcgtcatcgccctgcgtttggccatcatggggttcgtgctgccgttcctgttcctctaccgcccggccctgctattgcaggggacggcctttgaatggttctgggcggtgctgatggtggtatgctttttgttttgcttcatcatcgtttgtgaaaaatatttccgcatccagaccaccctggcggaacggatcgccgcgggcgtcggggcgctgtgctgcatcattcccgtctatgtgatggatttcattggtctggcgctgtttttgttcctcatcgtcagccagcagcgtcgggtaaaacgggaaggtcttgcttcccgcagccaggcttgagccggggagggggacgttctatgcagccggtatcgaaaaccatcttcctatgctgtaccatggacaccaaaagccgggagggcttctacctgaaggaacagctggaatcctacggccacaaggtccacatcatcgacatggggctgaaaaagtcaaattcctccggcgtttatctcacccaggcccaggtggccggcccgtactataaacaggttgtaagctgcaatgtgcgcagcgaggcttccagctacatggtgcgcgggctgaaagccgtcatccgtcagctttacgccgacggccaattggatgggatcatcgccatcggcggttcgggaggcaccaccatggcctccgccgccatgcatgagctgcctttaggcgtgccgaaggttgtcgtgaccaccatggcctccggcaacaccctgccttatgtgcagggcgaggacctgctgctgataaacccggtggtggacatacaaaacctgaattttctcacggaatacattctgcggcaggcggcggccatcctcaacggcatgctttgctgcaagccgctggaacgcaaggataaaaaggctatcgccattaccagcttcggggtcacaaccccctgtgtggaccgttgcaccgaactgctgcaaaaagaagggtatgaggtcctgcttttccatgcccgggggacgtccggcgggaagatcatggagaaaatgatccgggaggggcatttctgcgcggtcctggatatcacgacctccgagctggcggacgaggtagcgggaggcatctacgcggtgggtccgcagcggctgcggggcgcgccggagatggggatcccctatgtggtggtccccggggcgctggaaatggtgaacctggggtcggaggaaaccctccagcccgcccaaaaggcccgtaccctgtattaccacagccccagttcggtgaaaatgcgggccgacagcgcggaaatgaaggaactgggggatatctttatggaacggctgcaaaacagccgccgcggcatgaccaaggtgattattcccgccaggggcttttccagtgtggatatgccgggaaaggtattttatgacccggcggccaatcaggtgttcatcaatgaggtcaaatacaagatgcccgacaatgtgccggtgatggtacaggacgcgcatgtgaacgaccaggcttttgcggatgtactggtgcgggaattgctgcggatgatacccaagacacaattttaaagggggacggattttatgcggtttgaacgtaaagcagtcctggccgccctgcgccggcaggtggaacaggggcgggccatcctggccgccgctgcgggcaacggcctggtggctcgtgtggaggaccgtgggggcgccgacctgattatcgtttataattccggccgttaccggatggacgggatcgccagcatcgccgggaacctgcccatcggggatgccaacgccattgtccgggatatgggacgccgtcagattctgcatatggtgcaggatacgccggtggtggccggcatctacggggtcgatccgacccgggacatgcgagccttcctggaggaactgaaagagatcggctacagcggggttatcaatttccccactgtaggcaaattaagcggtcgtatccgccaggagctggagcaggtggggatgggcttcgccaaggaggtggagcggctgcggatggcggcggaactgggctttttcaccatggcttactgctattgcccccaggaggcccggctgctggcggacgcgggagtggatatcattgtttcccatgtggggcttaccgccggcggggatgtgggagtctcccaggcaagcccgctggaacaggcgatcgaggatacctccgccatcctgtcggcggccctggagcgccggccggacatcctgccgctgtgccatggaggggccattgtcacgcccgaggatgtgcagcaggtggtgcgccgtaccccggctgtggggttcgtagccgcttccagtattgagcggctcccggtggaaggagctgtggggcagatggtgcaggcgctcaaaggcgtggtcctgtgaccagccgccgtgacccgccaaaggccgccggagcggtatgtcccgcaccggacggccgcaggccggcctttgcatggaaaccgctttgcttttatggcctggtcattgccgtcctgtgggtggcggctgcgtccgaatggcttaaccgtctggcgcctttgcccatgggcggggatggctattgcgtcctggcgcttcttatttttgccgtccttagctggtgcctgatgctggcacccatcgccgtcaccgccctgctgttgctggctctggttcctttcaccgggctgatgaccttcccgcaggcggtccaggccagttttggggacagcacctttgcatttttcctgggggtcctgttattaagcggcgcgttccaaaagacccctctggggcagaggattgtgctgctgattttccgggtatttggccgcaggccgcgggcagtgctgttggggctgatgctttcggggatgctgctggcgatgtgggtgacagaggtagccgccgcggccatcctgtatccgctggccctggccctgacccggcaggcacagggccgttctgatttttgcgccctttcccggacgctgatgatcggcgtggcatggggaccggccttcggcggtgtggcgacacccatcgccaccggggccaatctggtggcgatcagccatttacaggaacatgccggagtatcggttagcttcggtcaatggatggcggtcggcgtacccatcgccataacactgctggcggccggctggctgttgctggcccgggaactgcccgatggccaaaagctggagccggtggggatgcctccaccctttggctggaaggaggggctgctgctggcggattttttgctggcggtgcttctgtggattttcggggaacgagtcggactttccagccatcatgtggcgctgctggccggcctgttcctgtttttgcccggggtgaaggttctggagtggaaagagagtgtccagaaggtcagttgggattccattttattgatttgcagcggtatcctgctgggcgagctgctttaccaatatgggatagccgaatggatggcccggctccttttctgggaaccgctgctgcaaacgggattgttctttaccggattttatattgtcctcaccgtgtcggtgctgaaaattctgttcagcagcaacactgtggccggggtcatcctggtgccggtgatggtcacgctggcccaacggctgggggcaggggtctgggggctggttgcgccctgcgttttctcctccgccctttcctttatagtaattacctccagccccgtgaatgtcatcccattcgccgccggttactttacgccgggggagatggcccgccgcggcatcgtgatgacgctgatcgccgcagccgtcatcgggttttggctgacggtactgcaagtacgttgaataaggaaggccggcgcatgagacagctctgccggagtgccagtcgatgcgtctgcgctatttaaattcaagaagggccgcccgcctgcgctaatctgcgcaggcgggcggcccctttgcaggacgttgcatcaaatcgacaacccaaaacggacgaagtcttgcgaaaaagccctgaaaccatatggtttcagggctttttcagtggagcgggttacgaggctcgaactcgctacctccaccttggcaaggtggcgctctaccagatgagctaaacccgcaaatggtgccttcggtcggaatcgaaccaacgacacgaggattttcagtcctctgctctaccaactgagctacaaaggcgtaagcactggcaaagcttatagaagaaagatggcgacccggatggggctcgaacccacgacctctagcgtgacaggctagcgttctaaccaactgaactaccgggccatactggtgggaactacagggctcgaacctgtgaccctctgcttgtaaggcagatgctctcccagctgagctaagctcccacatttgccttttggatgtggcatccacaagcgacgaaatttattatactatgcctgtccggaaaagtcaaccattttaaatagatttttttaaaaatctacaatttttgaagctaaaaactgaaacgctgaaaaatggactgtgaagggatagattttctgagcaggccggcgtatgattgaggcgctgtccgcacacactaaaagcaggcggcgcgcagccattgccgccgaatttttttcagggaggcgcgcagaatgcatgcgttcgaaaaaaacagatatattcatcccgagggtccgggccgtaagatcctgcatggcaattacgcgcggattgacccgaacgcagaggttacaagtgcttttatcaatcaggcaatctcccaggtcgaaggataccgaaacgggacaccaatcgtcgacgaggatgacgtgatccgcgcacgcaattgggtgaatgaaaacaaattgtaaaaaaccggccggatattccggccggtttttattttcagggctcaaacatggatacagtccctagtcaaacgctaaaaaagggcggagattttcgagcgtctgctccccgatcccttcgatttctaagagctgttccggcgtatggatacggccaaaacgagagatatactcccggatcgccttcgcccgtgccggaccgatacctggcagttgtgtcagttcctcctctgaggctgagttaatgcgcaccacaagcccttcaagctcgggatacgggttgagaacgggcgcgggagtgaaacgaatcgaagcgggaacttcaggcggggcggaagcaacgccataccatatgagggcagcggttagaacaagcgccagaaaaccgacggttccatatccgattttccaccgcgcgccgttctttctttgcatgacggattgtccccctgccgaaattttgtcgaattcagcatatcacaaaattgcgcgaatgtcacgcgatatacagcaatacaagaaaataatgacagagacttcctgcgattacgaacagatggaagatctcgtgaaagccaaagcgttcggataggttggggcgcttaatcatatagatcaggccgccggcggtataaagcagtccgccggccgcgagcagcgcgacagcaggaacaggcagcgcggcgagcgccggcaggtcgattgcgatagcccatccaagcagaaggtataatgtggtgccaagccagcgcggggcattgatccaacagagtttcatgacgatgcctgccagcgcgacgccccagataaccgcggtgaatacctccgcgcgcggcgcgggcagcagcccaagcagaagcggcgtataagtgccggcgatcagcacataaatcatcgcatggtcaagtttgcgcagcacaaccagcacgttggcggcggctcgtgaaaaatgatagatgccgctggcgctgtaaagcgcgatcagcgacaggcagaacaggatacaggagacagcgttaagcggattctgccccggtgtcagcgccaactggattgccatagccaccaatccgatcagggataaggccgcgccgataaagtgggagtagctgctgattggatcgcgggccttctgaaagattctgggcataataaacacctctaaaactcgtaatgtagtttttataactacttaatatatttattatatatcaaatgattgaaaaatcaatagaatattgtggttgatattaattttatatataatggatataacaagatgtggaggcgatccgatgaaaccgtttgacgaaattctggaacaggcattccgggacgctgatttgcaggctgccgatgtgccgcgcatcgacctgtatatggaccagattctgactctggtcgacgaggggcttgcgcgcaacaagcgcctgccggacgacaagctactgacaaagacaatggtcaacaattacagcaaggaacgccttattatgcccgtccgcggcaagaagtattcccgcggccaggtaatgcagttattgtgtattctgacactcaagcagcagcttgcgctttccgatattaaaaagcttgtttcatgcgggcaggacgaaatagactttgaacatgcatatacgcaggcgcttttaatgaaagagcgattgcgcgggcgtctgcccgaactgctgcgcgagttggttcagccggacggtgaaatgcccggcgcgcgtgagacgcttttggcgcgttcgcttgcgctttgcgctgcggccacgcagatgcgccgcgtgtgcgaggggctgatcgactcctggcaggaggatgaaaacatataaaagcggcggccaaaagggccggacggcagcgccgtccggcccttttggccgccgcttttcagcggaccctgtccggtgttttggacagatgcgtttttttgaatgttttaagtgtgaatatgcccgcgcatgaagaacagacgagaaagcggcgtccatcccggcgcagaaagcgcaggccataaacggccgcatcacgctgcgcgtgaaagacggacatttgcccgcgctgtccgcagtgcgggcagcgaatattgaccgttcccgatggtactatatttgtatggatactgaatatattttttaggagcatggagcgtccccctcacacttgcttgcacagcataagtacggcgcttttttctgaattttaacaaagtcgctgctgcttatttactagtttatacaaaatgttgaaaatgtcaatgacgatcacggaaagttttgccgggctattgacctgccggtgcgtaacgtgtaaaattatgacgaatgcttgcgagaaggagtcgaacgcatgaaaaaggttttgagcgtgatattatcggtgctgatgctggctgtggctggctgcggccagattgccgcgggcgcgtcgtccggcggggaagaaacgccggttacgctgaaccgtccggagcacacgagcgtatacggcgttgaagcgcccgacagccgcgacaggcaggcgctcggcggcgcgcataccgcggtgctttcctcgtcggttaacggcgaggtgcgcggcgtgtggatctcctatctgacgcttgagccgatgatcaagggaaaaacacaggcgcagtttgtaaagaacatcggggacgcgtttgaccaggcggccgactttggattcaatacggtatttgtccacgcgcggccttttggcgacgcgctttataagtccgaatatttcccatggtcccgttatttgacaggtgaggaggggcgcgaccccggttacgacccgctggaattgatggtttcgctcgcgcatgaacgcggtctgcgtattgaggcgtggatcaatccctatcgggtacggctcgacgacaagcccatgtcggcggacaaccaggcgaaaaaatggctggccagcggcaatgacggcgcgctcgcatggaatggcggcgtttattacaatcccggcagcgccgcggcgcgcgagctgattgtaaacggcgtgcgggagattgtggaaaattatgatgttgacggtattcatttcgacgattacttttacccgactacagatttgacgtttgacgcggcgacctatcaggcgtccggcagcagtctgacgcaggccgactggcggcgtgagaatgtcaacaagctggtgcatgacgtttacgccgctgtgaaggaggccaatcccgattgtctgttcggcatcagcccgcagggcaatgtggacatcaactacaacggtcagtttgccgatgtgcgcacctgggtttccgagccgggatatgtcgactatatctgtccgcagatttattatggttaccgcaacggcaccgctccttacgcggaaacggtcgctctgtgggacagcatgattaaggtcgataccatcaaactgtatgtcggcatcgctgcatacaaggtcggtacggtcgatacctgggccggcgagggaaagaacgagtggattgatacgacggacattctggcgcgtatggtcaagacggcccgcaaggcggagcattatggcggcattgtaatttacagctatgaatcgctgttcggcgatgtgtctgaacagatgaagatcgagcgcaacaacctgaaaaaagtattttgacccggccgatgagacaggacgcgcggcctgcccgccttacaaagcaggctgcgcggtaagtctgtgcggtatatcgccgcgccgcggatataaccaggcccggcggaacggtccgccggggcggggaggcaagctgtgtttaaagacgcccccaatcgaaaaaaactgatcctcgtcctgtcggcagtgttcgtttctctgacactgctgacgggcgttttggcttatctgagcggtccgcttacggagcttgcgcaggggccggcgcaaagcgaaggctccgggccttcggagagccggccggacggcgaacaggggatggatggtgaaatctccgaacaggacggacagacagcggattcttcgcaggcgtctgtgccgccggacgtctccgctgagaaccccgcgccgccggacgcgtcgtccgcgccgccggatacggccggggagacggggacggacagttcggataacggacaggcggacgagcctgtttatttcaacgtgccgaccgagatgcgcggcgtgatgatctccgcggggaccgattatctgacgaacgggacggatgtgagcgcgcaggagcttgccacgcagcttgatgaagcgcttgccgccgcgcagcagctcacgatgaacacagtcatcatcgacacgcagtacggcgacagcgtcctgtttgagagcagcgcgctggagagcgcgccgcttgggcttgacgtgacggagtatctctgcgcaaaggcgcgtgaaatgggtttttacgtctatgcgacatatgatgtctcaacccgttcgggcggagaggggctgaccgccgacggcgcggctcttgacgacctggcggaaaatatcggcgcgtttgccgaagcgtacaagccggacggcattctgctcgacggctatgagtgcgcggacagcccggcggcctatgccggttatctgcaaagcggcggcgggatgggctatgaagcgtatcagcgccaggtcccgcgcgcgctgctcgagacggcggccgcagcggtgcgtgagaatgcgccgggcgtacaggtcgggctttatacgcaggcggtctggcagaacagcgacgccgacccggacggctccgatacgaaggctgaaacgacggctctcggcacgggcaacgcggatacgcgcgcctttgtaaaggacgggctgtttgattttgtgatggtcaaaaactacggctccacgaacgaggagacggcgcggttcggcgttgttgcggcgtggtgggccggcgttgtcgacggtacggatacaaagctttatatgatgcacgccgccgaccgtgttgggacgcagtcggtcggctggacggtttatgagcagctcacggcgcagataatccgccttgaggaggcaggcggcagctctggcagcgcgtttaattcgctcgcggccctgcgcagcgaccccggaggcagcacgacgacgctgatccagtatttaaacgacgagatcaacgagcagtgggtgctcacgcagctcgctgtcacaaagccggcggagctgacctttacgacacaggaacaaaccgtcaccttccagggcgcctccgacccgcaggcggatgtgacgctcaacggggaaaaaattccgacgaacgaaagcggttactttacaatccgcgaggaactcaaggcgggactgaatacctttacgatcgaacacaagggcaagagcctgacttacaacatcacgcgcatcgtgcaggtcatcaaggaggtcagcccgacagggaaaatttccgtagacggcgggatgcaggtgtccgtctccgcgctggcttatgagggcgcgcaggtgacggcgagcgtgggcgggcagacgatccagctcaccgaaacggaggacgacacggacgaggccgagcgcgattcgggctaccggctgtatgtcggcgtatttacagcgccgagcgcgtcggcgaccgctacctcgatgggcaatattacctttaccgccactgcccagggagagacacagacgatgcagggtgcgtccgtcactgtcaacaagctcgccgtgatgggcgacggcgcggtcgtttatgttaccgcggaccaggccgagacgttcccgaccgacacgctcaacgacaattcaaatccgaattatttcccgctgccgcagggaacggttgacaagacgtatggcgacgagatcgtttataaaaacggcagcgtgaccaagacctattggaagctggaatcgggcgtgcgcgtctattcctccgatatcaaggcgagcggcggagctatgccggatcagaacgttatttccgatatgcgtatcaagacttccggttcgtatacgactgtcacgctcgatatgacacagaaggtcccctacaaagtggagtacgacggcagccgccttgtgttccggttccaatacacggccgaaacgcccggttccgccgatggaaagggcatctttgagtccgcctcgtgggatgggtcaaatctggtgctgacgcttaaaaaggcgggtggcttcatcggatacagagcgtattatgagggcgacagcctgaacctgcgctttcacaattccccgggcggcctttcgggcgcgcgggtggtcgtggacccaggacacggcggaaacgacccgggcgcggagggtttctatccgggcaaggacgaagcggatatcaactacgcgatcgctgaaaagctcgtagcggacctcaagagccagggcgcgtccgtgctgatgacgcagccgggctccacgatggccacgcgtctggcggccgcgcgttccttcaatgcgcaggtgcttgtcagcgtccacagcaacaccgcgccgaacagctcggccaagggaacggaggtttactatttctatccgtttgcaaaacagcttgccgccaatatatccgcaaatgtggcgtcggcgctcggcacggacaaccgcggcgcgaaagccgggctttactacatgacgcgcgaaagccagtttgcttgcgtgttggctgagattggatttttgtcgaatgacgacgaatatacaaagatgatcaattccaaatatcaaaaccgtatcgcagaagcgattgcaaacggcgtaagcgcgtatctgggggggacaagctccggatattacggctccgacgatgaggaggaaggtgacgatgaggacagcggcgatgaggatagcggcgacgcggttgaaagcgtatcgctcgaccgcgagaagctttcaatgcgcgtgggcgagacatatcagctcgaggcgaccgtccgcccgcggacagcggagaataaggatgtcacatgggagtcggatgacgaggatgtcgtcgaggtatcgccgtccggagagctgaccgctgtcggcgagggagaggcgcaggtcactgttacgacggatgacggcggcgagacggcggtctgcaccgtcaaagtgcgcggcgacgcttcggacgatgagcaagacgatgagcaggccgacccggaggaaggcgtgcttgtggaatcgatttccatttccggtccggacgagctggaggcggatggctcccgcagcgaatacaccggcgaggtgtcgcctgccaacgccgaggaccccggtatcaagtggagcgtgagcgatccggatattctggagatttcaaagatcagcgacgacgagcacaccgtatatgtcgagggactccaggagggcacggcgtatctgatcgccgagggctacaatggcagcgaggccatcgaaaaatttgagatacgcgtggtttcatgacgtaagcgcgctgcgggtattttcgtattgcgtctgctcacaaagtttgatataattattcagaaaaatttgtttattagtttacaaattttaaaaacagaacccgcatgcgcgtggttcgggaggcaggagtgaaagaatgtacaaaatcgtaagaaaacgcgccctcaatgacagcgtgactttgatggaggtgcaggcgccgcacatcgccaaaaaagcgaaggcgggccagttcatcattttccgcgtcgatgagcagggcgagcgcgtgccgctgaccatcgcggattatgaccgcgaggccgggacggtgacgatcatttatcagattgtaggcgcttcgacaaagctgctcaatacgctggaggagggcgatagtattctggactttgtcggcccgctcggcgtacccacgcatattgacccgaacgcaaagcgtgtttgcgtgatcggcggcggcgtcggaacggcgattgcctatccgcaggccaaagcgctgcataacgccggcatcgcggtcgatatgatcgcgggatttcgttcgaaggatatcgtgatccttgaggacgaaatgaaggctgtcaccgaccatctgtatatcatgaccgacgacggcacctacggcgaaaaggggctcgtcacaaataagcttcaggcgctgatcgacgccggcgaacagtacgacgaggtgatcgcgatcggcccggtcattatgatgaagtttgtcgcagccaccacaaagccctacggcattaagacgctcgtatcgctcaacccgatcatggtcgacggaacgggcatgtgcggcggctgccgcgtcaaggtcggcggccagatgaaatttgcatgtgtcgacggcccggattttgacggccatgaggtcgatttcgacgagctgatgcaccgcaacagcttttataaagagcgcgaggccgcggatcgcgaggacccggcccatatctgccgcctgacaggaggaaaacgcaatgcctaatatgtcgcctaagaagcatccgatgccggaacaggcgccggatgtacgcaaccataatttcgaggaggtcgcgctcggctatacggctgagatggcgatggaggaagcgcagagatgcctgcactgcaagcatcagccgtgtgtggccggctgtccggtcaacgtacatatcccgcagttcattgcaaaggtggctgagggcgattttgccggcgcataccgtgaaattgcgctgaccaacggcctgccggctgtctgtggacgtgtctgcccgcaggagacgcagtgcgagggtaaatgtgtgcgcgggatcaagggtgaaccggttggaatcggccggctggagcggtttgtcgcggactggtggatggagcatggagacggtaaaacagaaaaacctgcctccaacggccaccgtgtcgcggtggtcggcgctggcccggccggtttgacctgcgccggcgatcttgcgaaaatgggctatgaggttactgtgttcgaggcgctccagacggccggcggcgtgcttgtctatggaatcccgcagtttcgtctgccaaaggagatcgtcgcgcgcgaggttggcgcgctcaaggagcttggcgtcgatattgagacaaatatggtcatcggcaaggtcgattcggtcgacgaactgtttgagcagggctatgaagccgtgttcatcggttccggcgcgggcctgccgagctttatgggcatcgagggcgaagggctgctcggcgtctattcagccaatgagtatctgacacgcatcaatctgatgaaagcatatcgtgaagggtacgacacgccgattgcaaaatcgaaggcggtcgccgttgtcggcggcggcaatgtggcgatggacgcggcccgctgcgccaagcgtatgggcgcggacaccgtttacatcgtttaccgccgctccatgcaggagctgcccgcccgcgccgaggaggtccatcatgcgcaggaggaaggcattgtctttaagctgctcaacaatcctgtgaagatcatcggcgatgaaaacgggcatgtcacagggatcgaatgtattgagatggagcttggcgagccggacgcgtccggacgccgccgtccgatcccgaaggaaggcagcaattttgtgctcgacgtcgatacggtcatcatgtcgattggaacaagcccgaacccgctgatccgctctacaacgaccggcctggaggcgaataaacacggctgcctggtggcggacgaaaagggcgcgacgacaaagcccggcgtgttcgccggcggcgacgccgtgacaggagcggcgacggtgatcctcgcgatgggcgcgggaaaaaccgccgcgcagtcgattgacgaatatatccgttccaaaaattaaacgtcggtcatattcagaacctgtattcacagccggaggatgctggacaggcttttaaaacggggcgcttaaagcgccccgtttttctgtgcccggcgggctgggccggcgggcatgattttttctccgcgtgcatagacttgtcttatcagggatcagcgccggtttaccggcaggcttgcccctacaacctcagacaactggttccagataaaggagaaggacgattatgacggttcatacaccccatcccccgcgcagacggccgggtgtgccggtacgcagcggaaaaacaaaggatccctacctgtttctgatgacggtgcagattgtgctttgtgttttgcttggcggcgcgtcattcgcgttggcacaattgaatccaacgcttgcgcatgaggttggcgcgcaataccgcgcttatttagaatcggacggcgccggtctgacgctggaatttccgtctgatctgccggcccgcgtcggacaggcagccggccgtgcggccgattggctgtcgcagaaggccggcggcttattcatgccgcgcggtcagacgccgccggaggctgtcggttccacggctgatgcacagcagccggcagacagcgaacagcagccatcggcggaaagcatgccgcttgacgcctggaacgcgtttgtaaaggcgcaggcggatgacggcgccaaagacgccgcctttggcgagacggaagcaacagcacagacagcatccgcacagcccggcggcgcaggcggctggatggacgcaaagaaggaggaaggcaaggccgcgccggaagcctgcgcgctcgctccaatttttgtttccgcgcttgtggaaccgccgtcgtcgggcacagtgacctccctgtatggctggcgcgaacacccgatcagcggtgcggatgattttcaccgggggcttgatatcgccgcgccggagggtgtgggcgtatatgccgcgcttcctgggcgcgtagccgaggtggatacgtctgccatttacggcaattacatcacgctcgaccacggcggggggcttcaaacaacctattgccactgctcaaagattgtcgcgcctgccggcgcgaatctgcgccgcggcgagctgcttgcatatgtcggcagcacgggcatttccaccgggccacatgtccattttgaaatcagcctgaacgggaagtattataatcccgcctgggtgttggacgggatggacggctatggggtttaagtttcatgggacacactatttttttacatttggtttttttatggtgctggcgctttatatgctgtttgaccggacaggcgcgggcttgccggcgctttgctgtgttgcgctgcacgagtgcgggcacatcgcggcgatgcatttagtcggcgcgcgcgtgaccgatttgcagttctgtgcgttcggcgtgcgtatgaaaaaacagggcttgctttcctatggacaggaggcggcggtctatttcggaggcgcggcggcaaatcttgccgcgctggcggcggtctttccgtttgccggctggaacttattcacaacggcgaacgccgcgttagcggtatttaacctgcttcccatcggccggcttgacggcggcgtcctgctgcatcttctattgtgccgtgcgggcggtttggagagagcggatctgctgcgccgggtgatcggctttgttattctgacgccgctgtttgcgggcggcttttggctgcttatgcgtggaaactgcacgcttctttttacagcggtctacctcgccgttacgcttctgtgcgcatgaccggtacgagccgccccgactggggcggctcttggcaatgcaggaaaaatggtgggggaatggggaattgtgttggggaaaaattggttgagacacaatgcgtaatatggtacaatatgcgcagtgcaaacggcaacgccgtttgcagcccccttatggcggctgccgctgcaaagcagcggactgcgcatgttacaccacagccaaaaccggctttgccggtttcactgccgctttgcggcaggcaagcccgaatgggcttgttgctgtggtataataaccgcagagcggttattataccaatcttatggccagggcgatacgcgggcgcggcccgctcccgccatgatggccgattataccatgccgcttcgcggacatggtataataaccgcagagcggttattatacgggggttatgcccaacggctcgccgcttgcgcggcaaccgccttttgatgggcaatgataccatgccgcttcgcggccatggtatcatatgtgcagagtaaatggcaaagccgtttgcagccgccatccaatcgcaaagcggttgcttcatctgattatggcagattcagcatgggtaaactgaatgtatcgccggactgtcagaaaacagcgggatggttactatataaagaaaaggatggacaagctatgaaaatcattgccccccaggcatggagagaggatatcgcactatttaaagaaaaaacggacgctttctacgcaggggaactggacaagggcgcctataaggctttttccggctactatggaagctacgcgcaaagaggcgggaaggcgaatatgcttcgcctgcgcatgacggcaggccgtgtgaccagggagaaaatggaatatacggcaaaggcgctgcgtcaatatgatgtaaaaaggctgcattttaccacgtgtcaaaccattcagctccacgaccttcagcccgaacaggtatacggcattatggagggcgctctggatgcgggaattgtgacaatcggcggcggcggggattttccccgcaatgtgatgtgttctccgctttccggcgtggagcaggatgaattttttgatgtgctcccgtgggcgcaggcggccggggagtatcttatgagctttatcaaggctgagaagatgccgcggaaattaaaggtcggattttccaattctccaaagaatctgacgcatgcgacgttccgcgatttaggctttgcggcaagggcggacgggctgttcgacgtatacagcgcgggcggtcttgggaacaatccccgctttggcgtcagggtggcccaggcggtccagccggaaaaaatcctttactatatcaaagccatgtggctgaccttctgcgcttacggaaattatgaaaaccgtgcaaaggcgcgcacccgttatatgcaggacgcgctgggcggtcccgaaaactatgcaaaggcgtaccgcgagaaattggacgaggcgtttggcggcgaggatctgacgattgttgtagagcctgtcgcttttgataagcagggcgacggctccacggcgcagggccgccgggtcctggagcaaaagcaggagggcctttacacggtgcagtggcatccgatcggcggacagcccacgccggaggaattttgcgctttaagcgatgcattggcggagatgcctggcgcagaaatgcgtctcgcgccggacgaaacggcctatattatcaacctgacaggaaacgaagcccaaaaggtgttggaattgacaaaaaacagcgccggtacactgttcgaaaattcagtaagctgtattggagcgcagatctgccaggtaggtttgcgtgattcccaggcgctcttgacagcttgtatagatgcggtgcgcaaggcgggaattcccgataaggccctgccccagattcatatttccggctgtccgtcctcatgcggcactcatcagattggcgcgctgggcttcagaggtggtgtgaaatccgtggataagaagccgcagccggcgtttgtcctgtttgtcaacggggacgagcgccagggcaaagaagccatgggacgggaactggggacgattttggagacggagattccagcctttctggtggaacttggaacggccgttgcgaaaagcggaatggattttgacgcttggaacacggccgaaccggaggcgttggaacgtattgccgcgcagcacctggcttgatgggaaacattacgaacaggcatgccgattcttgtccgctgaacgtatcattggggtttgcttgagaaagacggatattccagttttttaagcgttcccccgctgctgtacagctttgggccatgcgggccgctgaggtccgcatggccttttatggagctgcgcggcggggcggcaaagatacgcataatgggaattgtcaagaaattgatggaacttgaaatacagggatgtttgcgatacaataacacatagtattatgggatggtttgcccttgtggaaggatgtacgaacacatgaatgtcagaaaggcgctggagagggtgcttttgcaggtgcagaagcccgcgcgttatacaggcggtgaattgggaagcgttgtgaaggacgcggcgtcggtggacgtgcggttcgcgttctgtttcccggatttgtatgaggtgggcatgtcgcaccttgggatgaagattctctattcgctgatgaacgcacgcgacgatatctggtgcgagcgggtgttcgcaccgggcgacgattttgaacgcgtgatgcgcgaacatcaaattccgttgttcgggcttgagagcctggatgcaatcgctgattttgatatgatcggctttacgctccagtatgaattgagcttcacggcgatcctcaacatgctcgatctcgcggggctaaaggtgcgttcaaaggaccgtccgggtttcgctccgctcgttgtggcgggcggcccgtgcgcctgcaaccccgagccgatcgccgatttcatcgatttgtttatcctgggcgagggtgaggaggtcaacctcgagctgatcgacctgtacaaaacctgcaagcgcgagggcgcatccaaggaggcgtttctgcggcgcgccgcgcagatcgaaggcatctatgtgccgtcgctttacgacgtagcctatcggcccgatggcacgattgccgccgtcacgccgcgcggggatgcgccggctgtcgtgcataagcgcatcatccgcgatctggacagcgttttttatcctgaaacgttcgttgttccgtttacggagaccgtccatgaccgcgcgatggtcgaggtgctgcgcggatgcatccgcgggtgccggttctgccaggccgggttcatttaccggccatttcgggagaagcgccacgaaacgctcaacaaaaacgcgcgcgccctgtgcgatagtaccgggtacgacgaggtatccctcacaagcctttcaacgagtgattattcagagattgagccgcttttaaacgagatgctcacctggacggagcctgacgcggtcaatattgcgctgccgtcgctgcgcgtcgataatttttccagggagctgatggagcgcgtggcggctgtgcgcaaatcatctctgaccttcgcgccggaggcggggacgcagcgcctgcgggatgtaatcaataaaaacgtcacggaggaggaggtcctgcgtacctgcaaaacggcgttttccggcggttatacaaatgtaaagctctattttatgatggggctgccgaccgaaacggacgaggatatcgcggggatcatccatctggcgcagaaggttgtggacgcgttttaccacatgccggacaagccgaagggacgcggcgtcaatgtgacggtgtctgtggcgtgctttgtgccgaagccgtttacgccgttcgagttcgaaccgcaggacacgatggaggaattgcgccgcaaacagaaaattttgcttgacacggtttcgtcgcgtaaaatttccgtcaaataccacgacagcccgaccagttttctggaggcggcgctcgcgcgcggagacaggcggctgtgcccggtggtcgaatacgcgtggcgcgaaggctcgcggcttgacggctggaacgatttcttttccatggagcgttgggaggacgcggccgcggtctgcggcgtcgacttctcattttacgccaaccgccggcgcgcctatgacgaggtgatgccgtgggaccatctcgattacggtgtgtcgaaggcgtttctggtgcgggaaaatgagcgcgcccacgctggcggcacaacgccgcactgccgcgcccattgctcgggctgcggcgctaaccgtctgttgggaggtgcgtgctttggggactgatctgtttgccgtgacggcgcgcgtcttttataaaaagcagggacgcgcaaagtatatttcgcatctcgacctggtgcgctgcatttcacgcgcgctcaagcgttcgaagctgcccgtatggcacacgctcggctttcatccgcatgtgtatctgacgtttgcgctgccgcttgcgctcggttatgagagcgaatgcgaatcgatggatttccgcctgaccgaaacgctgccgatggaagccgtcgtcgaccgcctcaacgccgtgctgccggagggaatctgctgctatgcggccgcgcccgccgtcatgaagccggacgcgatcaaatgggccgactacacggtgacgcaggagtttgacagcgtggacccggatgaagcgtggcgggcgttcgcgggctggtgcgccagagagacggttccggtcgtcaagaaggggaaaaaaggcgagcgcgtcgtcgatgtgaagccgcattttacccttggggaaccgcatgctgaaggcgatacgctgacattttccatccgcgcggctgccggcagcgcctttaacctgaatccgacgctgctgcttgacacgttcgcgcaggagggcggcgcccgcgccggttgggtgcgcgtggtgcgcacggctgtgctcgacggaaatctgcggccgttcgagtaagcaaaacgatgccatgaggaggtatttgaatatggttacaaggaaagaaaatatccgccccattataaaggagcagatgcgcggcggcgacggacgcgcggtgcagacgccggtgatcgatgaggcgcagttttgcggccatggacgcctgtttgcaaagatgacgcttgagccgggctgttcgatcggctggcacgagcaccacggtgagagcgaaacgttttatatcctcgccggcgcggcgcgctactgcgacaacggcgaatgggtcacgctgcgcgcaggcgactgcgcatacacgccttccggcgaggggcacagcatcgccaacgccgggacacagccgctcgaatttatggcgctgatcgtcaaagcctgacggcaaaaggtgcatcggaaaaaattttggaaaatgcttgcattacaaagtgcattgtggtaacatatataagcatgtaatgaacgttggagcctgcaacgggcgttcgtgcccaatcctaccgggattgtacatgaaaccggacagtcctctgccatcgctcgaatgggaatgaatgtctgtaaaaagaaggaggaagcgtaaatggacgctttgaagcacattgtcagcgactgcgcgaaagcggagctgcccaagatcgagatcggcgacaccgtcaaggttcacgtttggatcaaagagggcgagaaaaagagaatccaggtttttgaaggcaccgtcatcgccaagaagcacggcggcatctccgagacctttaccgtccgccgtgtagcgcacggctgcggcgtggagagggttttcccgatccattcgcccaacatcgacaaggtggagctggtccgcaacggccgcgtccgccgcagcaagctctattatctgcgcgaccgtgtcggcaaggccgccaaggtcagggatgtcatccgctaaaagcagcggggcgcctggggaaagggacgtggaaacgtccctttttcgttttctgcgcccgataacgacgcgtttcgttattgggcgttttttgtttacaatccgcttcttgcatcgcgttgcgcggtgtgatacgatggaggggacttcagggacgcgccgcgtccgtgggaaggaggtcgcgccgtggaaaacggattgccgccggagtggaagcgagagtgggattttcgctatgatatcagaaattcgctcaacaacgtgcgccgtccgggcgaagcggtcacggagctgtatgaatggattgaatcgtgcgtgctggcaatcgtcgtaattctgacgctgtttacatttgtgttgcgcacagccacggtttcaggcccttcgatggcgccgacgctgcacgacggcgaccgcctgattttgatgcaggcgggttataacgatccgcagtatggcgatatcgttgtcatcgaccgcgccgcgcacagccagccgccgatcatcaagcgggtgatcgggcgcgcgggcgacgagattgatattgatttcgatacgggtgaggtgcgccgcaacggcatgttgcttgacgagccatatatcaatgaaccgacgtatataaaccttggcgccgagttcccggccgtcgtgccggaagggcatatttttgtattgggggacaaccgcaaccactcgtcggacagccgcgacgtatcgatcggcatgatcgatctgcggcaggtgatggggcgcgcggtgttccgctttttcccggtcagcgcggcgggcgcgctgacagactgacaggacggaggaatcacgatggatacagagcgcgaagcggatatgtcctttgagcgggacgagccgaacgaaccggacggccgcccggacgcgcccggggatggaggacagcagcgcgcgggcggctcctgcgccgaggcgtacgagtgggctgaatcgtttcttgtgccgcttttgctgtttttggttgtgtttgtgttctttgtgcggctggcgacggtcaacggcatctccatggagccgacgctgcacgaggggcagcgtcttgtgttgcgccagatcggctatgagccgcagtatggcgacattgtcgttgtcgaccgtacccaggacggcgaggagccgcttgtcaagcgcgtcattggcaaggcgggcgacgttatctatatcgattttaacacacacgaggtctggcgcaacgacgagctgctcgacgagccgtatatcaacgagccgactgcgctttccggcgatttgactttcccgacgcgcgtgccggagggctgcgtgttcgtcatgggggacaaccgcaatcactcgctcgacagccgtgacagttcggtcggcatggttgacgagcggcgtgtgatgggtgaagcggtgtttcgcatctatccgctcgacaagatcggaggcgtctgatggaggagtttggatttgcaaacggcccggcggccgtggacatgccgtcaatccagtggttccctggacatatggcaaagacacgccgtctgatggcggacagccttcgcctcgtcgatatcctggtggagcttgcggacgcgcgcatccctgtctcaagccgcaacccggagatcgggcgcctagccggccaaaagccgcgtgtgttgctgctcaataaatgcgatgccgccgacgacgccataacgcgccgctggcttgattactatgcgggcgccggcctgcccgcgctcgcggccgactgccgcagcgggcgcggattgggggcgtttttgccgcttgtgcgcgagacgctcgcgccgcagcttgccaaacgcgccgccaagggcatggccggacagccggtgcgtatgatggtggccggcgtgccgaacgtcggcaaatcgtcgctcatcaaccggctggccggttccagacgcgccaaggtggaggaccgtcccggcgtgacgcgcgggcggcagtgggtatcgctcggcaagggcgtcgagctgctcgacatgcccggcgtgctctggccgaagtttgaggacccggccgtcggcgagcgcctcgcgttcaccggggcggtcaaggacgatatcgtcgatattgaattgctcgcgatgcgcctgctcgcgctgctggccgcggactatccagagcagcttgcgcagcggtaccgctttgcgccgggcgaggcggacggactcgacgcgtatgggcttttgcgccttgtcggcaaaaagcgcgggatgcttaccgcgggcggggaggtcaacacggagcgcgccgcgatcacggtgctcgatgaattccgcagcgggaagctcgggaaatttacgctggaggttccgccggagaaatgaatatgtacgagtttgaacaggccgcgcgccgggagggttatgcggctgtttgcggcgtcgacgaggccggacgcgggccgctcgccggagatgtgtacgctgccgcggtcattctgccgccggggcttgagcttgcgggcgtaaacgattcaaaaaaactgtctgaaaagaggcgcgaggcgctttacggcgtgattacagagcaggcggccgcatggtgcgttgcctcggcgagcgtagaggaaattgaacggctcaatattttacaggcgtcgctgctggcgatgcgccgcgcggtggaggggcttggcgtgcgcgcggatttcgcgctcgtcgacggaaaccgcgatccgcattttgaaggcgtgccgtgtaaaacaatcgtcggcggcgacggcaaaagcgcgtcggttgcggcagcgtcgatcttggccaaggtgacgcgcgaccgttatatggaacagttggccgcgcggtatccgcagtatggctttgagcgtcacaagggctacgggacgaaagcgcaccgcgaggcgctgctgaaatacggcccgtgcccggcgcaccggaagctgttcctgcgaaggctcgggctgtgagcgcgcgtacatacggcgcggccggggaggcgtttgcggccagcgcgctggaggcggagggctaccgcatcctggagcgcaactggcgcagcggccgcagcgagatcgacctgatcgcccagcgcggcgatatcattgcatttgtcgaggtcaaaacgcgcggcgaacacgcgctggccgcgccggcggcgtttgtcacaagggcgcagcgccggcgcatcgcgctggccgcggtggaatatctgcgtgcgcgcggcatatataatacgggggccgtgcagccgcggttcgacgtgtttgagatcgtgaccggcggcccggacggcgcgtgcgtaacgcgcttttcgcatcttgtaaacgcatacgatacgggggatctggatgtatttctttgacctgcactgcgatacaatcacccgcctgaacacaggcgagcgccttgagccgggggaccgcagcctgcgccgcaacggcgcgcacatcgacctggagcgcatggaggggctttcatggtgccagtgcttcgcggtctttatgccggatgggctgcgcggacgcgccgcgatcgattattatgagcagagccttcgctttttccgcacgcagcttgccgagaataaagaccgtatcgtccaggtgcgcacggccgatgaaatccttgctgcggtgaaggacggaaaatgcgccgcgctgctcacggtggagggcggctctgtgctcgcgggggaaccgtcgcgtgcggcggagctggcggccgacggcgtgcggatgctgacgcttacgtggaacggggaaaacgagctgggcagcggcgcggatatgccgggcggcctgacgcccaggggcgtcaaggccgtcgaggcgtgcgaggatgcggggatcatcattgatgtttcgcatctcaacgaccgcggctttgggcagatggccgacctggcgcggcggccgtttgtcgcgtcgcattcgaatgcgcgcgccgtctgcaaccaccggcgcaacctgacggatgaacagtttatgcgcatcgtggctgccaaagggctggtcgggttaaatttctgcacgcattttctttcggaggagattgccgatcccccgttttcgtgcctggcggcgcatatcgagcatttcctgtcgcttggcggcgagcagacgctcgcgctcggttccgattacgacgggacggatgtgccgtcgtggctcgacccggcgcgtaaggtggaggacctctaccagcttgtgtgcggggcgttcggccaggcgctggccaaccgtctcttttttgaaaacgcgctcgactttatgaaacggtacgagcttgccggggagggataggcggtggcgctgtatacaatcggtgatctgcacctgtcgctttccggcgatcatgcgatggatgtgttcccgggatgggagaggtatgtcggccgcattgaagaaaactggcgcgcgaagatttgcgcggacgatacggtcgtactgccgggcgatacctcctggggaatgtcgctggagggggcgctcgccgactttaagtttctggaatccctgcccggcaaaaaaatcatgctcaagggcaaccacgactactggtggacgactaaggcaaagatggaggcttttttttcggcgcacggattaaagtcgctgcaaatcctcaataataactgcgttgctgtggacggcgtggctgtctgcggctcgcgcggatggctgttcgagacgggcgagccgtttgacgataagatcatcaaccgggaagcgatccgtctggagctttcgatcgccgaagccgaaaagacggggctggagccggtcgcctttttgcactatccgcctctgtacggcgaaaacacgtcgccgcagattctcgatgtgctcgcgcgccacagtgtgcgccgctgctattacggccacatccatgcggccggatgccggtgggcttttgaaggggaacgcaggggcattttcttttcgctcgtcagcagcgattacctgcattttgacccgctgttggtggagccaggcaaaaaaactgctgatttttcgggaaattcataatttatctattggcatagacgtacctgtttgctataattacaagatagtgggcttataatatccagaaaggcccaacggatggctggcagacgcgcggcggcggtcaaggggactgcgcgcgggaccggccgtgatttccgggcaggtccgcttcggcgccgtccggccgttcctccatgaaaaatggcaggagcaggagaatttttcaggaggaagtagaaatgtcagttacatcgatgaaaacaaatgacgacaaacgcgtggagcttgaaatcaaggtggacgctgaaacgtttgaaaaggcggttgacgcggccttcaagcgcaacagcaagcggatgaatgttcccggtttccgccgcggcaaagcgccccgaaaaatgattgagcgcctgtacggagagggtgtgttttacgaggaagccgtcaacaatacgtaccccgccgcctatgaggacgcggtgaaggaaaagggcatcgagccggtcgaccgcgccgatatcgaggttatgcaggtcgggaaggacggctacagcttcaaagcgaccgttaccgtcaagccggaggtttcgatcgagggctacaagggtattgaggttgaaaagaaggtggcgcaggcgaccgacgcagaggtcgacgccgagctttcccgcatgcaggcgcagaatggccgtgtgattgcggtggaaggccgcgccgcccaagacggagataccgcggtgatcgatttcgagggctttgtcgacggcaaggcgtttgagggcggtaagggtgagaaatacccgcttgagcttggctccaacagttttatcgagggcttcgaggggcaggttgtcgggcataatgtaggcgatgaatttgaagtaaacgtcacgttcccggagaattaccatgcggaggaattaaagggcaagcccgccgtgtttaaatgcaagctgcacgagctgaaaacgaaggacctgccggcgctggacgacgaatttgccaaggatgtcagcgagttcgacacgctcgacgagctgaaagcggatttgaagaagaaagctcaggagcgccacgacagccgcagcgaaacagagacggagaataagctgatggaggctgtctgcgcaaagatgaccgtcgacatcccgcagtgcatgtatgagcgccgcatcgacgagatggtgcgtgagtttgagtaccgtctccagtcgcagggcctgaacctccagacatatttgcagtacgcgggtatggaacttgagtcgttccgcaagacgtatgcggcgcaggccgaggcgcaggtcaagacgcgcttggcgctcgagaagatcgccgagctggagaagctggcggcgaccgaggaggaaatcaacggcgagctgctcaagatcgccggaaactacaacatggacgttgagcgcgtacgcaagatcgtttcgcccgaggatgtggcccacaacctggcgatgggcaaggcgctcgatctcgtgcgcgacagcgccgtgatcaccgaggttaaggaggaggcggcccctgcggagaagccgaaaaaggcatccaagccgcgtgccaaaaaggccaagacagaggacgcgccggccgcagagacatctgctgaatccgccgaataatacgcgatcagtcggagaggggttcgccgcgcggccgcgcagcggaccccctcgtacataccggcgcgtacgcgctggttttatcatgcatcatgggccggcaggcccgcggctccgggcgggcgcccggatgaatcaggctatgggaggaatcagcatatgagccttgtaccaatggtagtggaacagacaaacagaggcgagcgttcctatgacattttttcgcgcttgctcaacgaccgcatcgtaatgctctgcgacgaggtcaacgatacgacggccagccttgtcgtagcgcagcttttgtatctggaggggcaggaccctgataaggatatcaacctgtatatcaacagcccgggcggctccgtcaccgcgggtatggcgatttacgacacgatgaatttcgtcaagtgcgacgtttccaccacgtgcatcggccttgcggcctcgatgggtgcgtttctgttcggagcgggcgccaagggcaagcgcattgccctgccgaacgccgagatcatgatccatcagccgtccggcggcgcgcgcggccaggccagcgatatgaaaatccataccgactggatcatccgcacgcgtgaaaagctcaaccgcatcatggctgagcagactggacagccgattgaagtgatcgagcgcgataccgagcgcgacaatttcatgacggcgcagcaggcgatggagtatgggcttgtcgataagatcatcgcgcacagggaataagttttgagttctgatgcgcccgtgtgtatataaaatggctgaaaggccgcgagcaggcggacgctgtgaaagataattgcaatggggatgatggccccgggaggttattcatggcaaagaacgacgaccagagggaattgcgctgctcattctgcggcaagatgcaaaaccaggttcaaaggctgatcgccgggccgggcgtatgcatctgtaacgaatgcgtggagctttgccagagcgtgctggacgacgacgcgccgcccgcgccgcgcgcccgccagaaccggcaggagcagcagatcgccgtgctcaagccgcacgagatcaaggaaaagctggacgaatatgtcattgggcaggagcgcgccaaaatcgcgctttctgtcgcggtttataaccattacaagcgcatttatttcggcgatgtcggcgatgtggagctgagcaagacgaacgtcctgttgctcggcccgaccggcgtcggcaagacgctgcttgcgcagacgctcgcgcgcatgctcaacgtcccgtttgccatcgccgacgcgacgacgctgaccgaggcgggctatgtcggcgaggacgttgaaaatattctgctgcggttgcttcaggcggctgattacgatgtagagcgcgcgcagaagggaatcatttatatcgacgagatcgacaaaatttcacgcaagagcgagaacccttccatcacgcgcgacgtctccggcgagggcgtgcagcaggcgctgctcaagattttggagggcacggtcgctaatgtcccgccgcagggcggacgcaagcacccgcagcaggaatttatccagattgacacaaaggatatcctgtttatctgcggcggcgcgttcgagggcatcgataagatcattgagcgccgaacggataaaagctcgctcggcttttcttcgacgcttaaaaacgtcaaagcgcgcgaccgccttgttcagcaggtgatcccgcaggaccttgtcaaattcggcctgatcccggagcttgtcggacgcacgccggtgctgaccgcgcttgaagcactcgaccgcgacgcgcttgtgcgcatccttacagagccgaaaaactcgttggtgcgccagtataagcagttattcagcctcgataatgtcgaattgacgtttgaggacggcgcgcttgaggcaatcgccgacaaggcgattgaacgcaagacaggcgcgcgcggcctgcgcgcgatccttgaggagacgctcggtccgctgatgtacgacacgccttcggaatatacgattgcgtccgtcaaaatcacgaagggatgcgttgaggggacggaaaagccctcgtttgtctatgatacaaaccgccgcccgacacgtttgcaaatctctacagcgcgccgcgtgcccgcccgccggcgtgagactgcgtcctgactggaaagcagcaatcctggcgcccgccggcgatgccggcgggcgctgttattattaaagatcagtttgcagaacacgttttggacatggcggtatttcccacacggccgccgtttacaaacgtggacggttatggtataatatgcgcagtgcaaacggcaaagccgtttacggccgccatatggcggcaaacgctgcaaagcagcggactgcgcatgttacaccacagccaaaaccggctttgccggtttcactgccgcttggcggcaggcaagcccgaatgggcttgttgctgtggtataataaccgcagagcggttattatacacctcatggccagggcgatacgcgggcgcggcccgcttccgccccgatggccgattataccatgccgcttcgcggacatggtataataaccgcagagcggttattatacacctcatggccagggcgatacgtgggcgcggcccgcttccgccccgatggccaatgataccataccgcttcgcggacatggtatcatatgcgcggggtaaactgccttgccgttagcagccgccgtcaggcaaaagaccgttgcaaagcagcggagcaggctgccggaatgatactgcgcggtgcgcggccggcggcattgcttttttgggcgggagagcggattgtatcctcaaccggccctgactatagatgtaaagcggccggtgggttgctttgctttcttgcatacccgggaatggaggcgcgaaatgagcgattcgatcgttaaaaaatcaggaatacaggaaccgccggagccggtgcggatgcccatccttgtgctgcgcggtcttgtgctgtttccgcagatggtgctgcacttcgacgttggtcgtgaaaagtcgctgctggcgctcaacaaggtgatgagcggcgaccgcaggatctttcttgtggcgcagaaggatatccgcgacgacgagccgaaagcgcaaaatctttataaaatcggcgttgtggcgcaggtgaagcaaattataaaatcacagggcggcacatggcgcgtgcttgtggagggactttacagggccaagctgatcgaggtgctcggcgaggagccgtactttgaaggacaggtcgtcgagtttccgctgcggatcacgcgcagcataaaatcggcgatgtgtaatgcgctgatgcggaccgtcaaagagctgtttgaggagtattgttatctgacgccgcgtatgccaaaagaactggtggtcaacgccctgatcagcgaggacccggttcacctggcagaatacataaccggcaacatccagatggaggtcgcggataagcaggcgatcctgtctcagagcgagccgcttaagcgattggaaattctggcgcacctgcttgaggaggaaaacgatattctctcgctggaggccgatattcaggagaaggtcaagggtcaggttgataagaaccagcgcgaatattatctgcgcgagcagctcaaggtcatcagcaatgagcttggcgaggacgacgagcaggacgaggcggccgattattatgagcgcatcgaaaagctcaagctcgacgggcagactgccgagaaacttcgcaaggaggtcgatcgccttacaaaactgccgggcaattcaaatgaagccggcgtaatccgcgggtacctcgatacggtgcttgaattgccgtgggacaaatgcacgctggacaaaattgacatcaaaaaggcgggggcgctgttggaccgagagcattacgggctgcaaaaggtcaaggagcgcatcctcgaacttttggctgtgcgcaagctcgcgccggatatcaaggggcagatcatctgtcttgtgggaccgccgggcgttggcaaaacatcaatcgcgcggtcgattgcaaaatcgatgggacgtaagtacacgcgcatttcgcttggcggcgtgcgcgatgagagtgatattcgcggccaccgcaaaacgtacatcggcgcgatgcccggacggatcatgaatgcgatgaagcttgccggcagccgcaatccgctaatgctgcttgacgaggtcgataagcttggaaacgactaccgcggcgacccatccgcggcgcttctggaggtgctcgactcggagcagaactacgcgttccgcgaccattttatcgaggtgccgttcgatctctccgacgtgttgttcatagcgacggccaatacgcttgatacgatcccgcggccattgctcgatcgtatggaggtcatcgagctgaccagctatacgcgcgaggaaaaatttcagattgcaaaaaagcatctttatcccaagcagctcaagcgccacgggctgacagccgccaaagcaaagctggccgacggcgcgctttatgcgctgatcgacaactacacgcgcgaggcgggcgtgcgccagcttgaaagggagattgcatccctgctgcgcaaggcggccaaacggatcgtttcaggcgaggaaaaaaaggtcgttgtggacaacgacaatatcgtttcgatccttgggccgcgcaaattccgtcccgaactgatctcgccgcatgatgaaatcggcctggtcaacgggcttgcctggacgtcggtcggcggagagttgctgcaggtggaaatcgccgttatggacggcacgggtaagctggagttgaccggatcgctcggcgatgtgatgaaggagtcggcgcgcgctgccgtcagctttatccgcacgcgctgggaggagtacggcgtcgatcatgatttctataaaacgaaggacctgcatatccatgttccggagggggctgttcccaaagacgggccgtcggcgggcgtgacaatctgcacggcgctcgtttcggcgctttcgggcacgcctgtgcgccgcgacgtggcgatgacgggcgaaattacgctgcgcggacgcgtgctgccgatcggcgggctgcgtgaaaaaacgatggccgcctatcgcgcgggcgtgcgcacggttgtgattccggcggagaacgaaccggatttggcggacattgaccccgttgtgcgcggcgccctgcgtttcgtaacggtggaacgtgtcgatacggtactcgatgccgcgcttgtggacaggccgcggaaacaggccccccagtcgctttcagctctgccggccgccgcgccggagcagccgcttggaaaggcgaattcaccgatcccgcaataaggcgcattggaaagggacgacatgaattatcacaacgtaaaatttgaaacgagttttgggacagcggcgcagctaccgccgtccgagctgccggaaatcgcgtttgcgggccgctcgaatgttgggaaaagctcgatgatcaacaagttgtttaaccgcaaacagctcgcgcgcgtttcggctgtgcctggcaaaacggcgacgatcaactttttccgcgccgatgggctgcgctttgccgatctgccgggttatggctacgcaaaggtttccaaaggtgaaaagcggcgctggagcgagctgatcggcggctactttgaacaggaccgcgacctgaggcttgtgtttcagcttatcgatatgcgccatgcgccgacagccgacgatctgacgatgatcaactatatgatcgaccgtgagattccgtttgttgttgtgctgacaaaggccgacaaactttcaaagacacagcgcgccgccaggctggccgcgcttgagacggagctgccgtgcgcggaccagatcgtgacgatccccttttcatccgagacgggcgagggggtcgacgctgtcagggacgtggttgcgcagatcgagcgcgactgtatggagcagccgccggccggataaggttttttttaatctgacaaggggtgtatgacaatgtttgtttccgactgccttgggctgaacgagcttggacatctgacgatcggcggctgcgatacggttgcgctcgcgcagaagtacggcacgccgctttatgtcatggacgaggatgaaatccggcgcgcatgcgccagctaccgcggttccatcgaacggtattacggcggccgcgggcttgtaacctacgcgagcaaggcgttttgctgcaaggccgcctgtaaaattgcggccgaggagggactggggcttgacgttgtttccggcggcgagctttacacagcgatcagcgcaaatttcccggcggaacgcattttttttcatggcaacaacaagacggttcaggaattgaccgaggcgctcgcctacggcgtcgggcagatcgtcgtcgataatttcgatgagcttgagacgctcaatcagctcgccctcagccgcggcgagccggccaatatcctgttcaggattaaacccggcatcgacgcgcatacgcatgattttgtacgcaccgggcagatcgacagcaaatttgggcttgcgcttgaaacgggcgaagcgatgcgggctgtacagacggccctgtcgatgcagggggtgcgtctgcggggcgtgcattgccacatcggctcgcagatctttgatatcgagccgtttgagcatgcggccgaggtaatgcttggattcatcgcggatgtgcgtgatcaaacgggatgcgagcttgaaattctcgatcttgggggcggattcggcatcaaatatctgccggaacacgacccggtcgaatatgaccgctacatgcagcgtgtggcacgcacggttcagcgcgtatcggccgcacgtggcgttaagacgccgtttattgtgattgagcctggccgttcgattgccggaccggccggcgtcacgctctatacggccggcgcggtcaaggagattcccggtgtgcgcacctatgtatcaatcgacggaggcatgtgcgacaatccgcgctatattctctatcgatctgaatatgaagcgatggtcgccaacaaagcgtcgcagccaaagacgcgcaccgttactttggcgggcaaatgctgcgaaagcggcgatctgatcggcgaggggatgcagattcaggatgtgcatcccggcgatatcatcgctgtgctggcgacaggcgcatacaattatgcaatgtcgtcaaactataaccgcatccctcgcccgccggtcgtcatgctgtgcggcgggcaggcgcgcgtggttgtgaagcgtgaaacctatgaggaccttgttcgcaacgatctggaataacaagtaaaataattttgcagtttgcgccgcaaaatcctttactttcgcaaactaaaatgataaaatatctgtaacagctatttttggagcctgcccgcgtgcgctgacagcgccgggtgggttcccattttggaggcggattgtttgaacacgaaactcaaggacatgaatgtagattatctgtttaaggcggtcctttcccttgaaacgatggaggaatgctacagcttttttgaggatctgtgcacggtcccggagctgaaggctctgtcgcagcggttggaggtcgccaagatgctcagtgaaggctgcgtgtacagcgatattgtatcaaaaacaggtgcttccaccgcaacgatcagccgtgtcaaccgatctcttaactacggaagcgacggttataaagtggtgttcgagcgggtgaaaggttaatggcatatcaagctttcgcgtcctattatgaccgtctgatcggaaacgaggtcgattatcgggcgcgggcgcgctattttgacgcgttgatccgccggtatgccgacacgcccgaacaaaacctgctgctggatttggcgtgcgggacaggcagtttgtcggtcgagttgagcgccatcggctatgatgtgatcggcgtggatgcaagcgccgaaatgctcgcggaggccgccgcaaaggggcgcggaaaaattttgtttctctgccaagcgtttgatacgctcgatctgtatgggacggtcggcgctgttgtctgcgcgcttgattcgctcaatcatatcaccgacgccgccgcgcttgaggcggcgttcgcgcgcgtcgcgctttttacggcgccgggcggcgtgtttgtgttcgatgtaaacacgccgtataagcatcgggaaatcctggcggacaacacctttgtgtacgatctcggcgatttgttctgcgtttggcagaatacgacggacgcatcgcttcaaacagagatcgcgctcgatttcttcctgcgcagcggcgcctgttatacgcgtgaaagcgagcggttttgcgagcgggcgtatacgcatgagacgctggccaaactgctggaccaggcgggctttgatctgtgcgcggtctgcgagggcgatatctttgatccgccgggggagacggcgcagcgcgctgtttatatcgcaaaaagacgctgcggacgggccgcggcggtcaattgaaaggacgaatggaatgggaaaattggtacgcgcgattgctgcgggcggtcttgcggtctgcacggccgtcgattcaaccgatattacggcgcgggcggagcagatacacaaaacttcggccactgttacagccgcgcttggacgcctgatgacagcggcttcgattatgggcagccagcttaaaaacgaggaggacagcgtcaccgtgcgcatggcgggcggcggcccggccggcacgctgattgcagtttcagacagtacaggcaatccgcgcggttatgtcgcaaaccccattgttgaaataccgctcaacgcgcagggcaagctcgacgtagcgggcgcggtcggcaaagaagggatgctgacggttatcaaggacgtcggcctgcccgaaccggcgaccggttccgtgccgatcgtttccggcgaaattgccgctgatgttacaaactattatgcggtcagcgaacagacgccggccgtctgcgcgcttggggtactcgtcaaccccgatttaagcgtgcgcgccgcgggcggctatctggtgcagcttttgcccggcgcaggcgaggatgtgatttcccggatcgaggagaatatccgcgatatcaagccggcgtccacaatgatcgacgaggggatgacgcccgagcagattatcgatactgtgatggccggcctgtcgccggaggtgctcgagacacgtacggtcgcttacacatgtacctgttccaaggcgcgcgtcgagcgcgcgcttgtcagccttggccgcgacgagctgcgccgccttgcccgggagcaggagacggcgcaggtggagtgccatttctgcgataagacatacacgtttacgcgtgcagaacttgaggcgcttttaaatcggaaataaatgaatgaaaaggctccccgctgctgcggggagccttttcattacaatctgttatttcagcttatatgtatccttatagtgcttacaacagaccttgaggacgcaggcgtcgcactgtggacggcgcgcgacacagacagcgcgtccgtgcaaaacaaggcggtggcaaaaatcgtttgactcctccggcggaagcagcggacgcaattgattttctaccttgacagggtcctttccttcggtcagtccgagcagatttgtaatacggatacaatgggtgtcgcagacgatcgccggtttgtgaaacacgtcgccgacaacaagattggcggttttgcggccgataccgggcagcttggtcagctcctccacagtgtccggcagttctccgttatacttctccataagcatctgacacatggcgatgatatcgtgcgcttttgtcttatacagcccgcacgacttaataatttcctccacgtcggtcaaattcgcttccgcaaaatcccgcacgctcctgtatttatcaaacagatcgacgcagacaatattgacgcgcgcgtcagtacactgagctgccaagcgagtggcaatcatcaattcgtgcggcttgcggtattcaagcgaacagatcgcgtccggataagcctctttaagcaggcgcacagcctcgtgcgcagcttgttttttggtcatgggaaaccctccttcaaaacgtcagtggagcgtcggcaaaaacgcgtggaacaaaaagccgaaggctccggaaatggcgatcagccagatggggtgcagctttttacgccagcggctgataagaaagacgatcaatacaatcagcacggcgcgccagctgatggacggcataccgcggaaatagagcagcgcgcgcgggctgataccgcccagagcgacggatgtgaagatggaaagagcagcggcggcaatcagaccgacgactgcgggacgcagcccatacagagccgctttgacatatttgtgatcctggaaatgagcaaaaaatttggcgatgatcaggataattaaaaacgagggaagcacgacgccgagcgtggcggaaacagcgccgataagcccggcctttgacatgccgacaaaggtagcgatattaattgcaaacggaccaggcgttgattcgctgatggcgatgaagtcgatcaaatcgctctgtgaaacccatccatgggacaggatatcctgctggatcattgggatcatggcatagccgccgccaattgtaaacaagccgattttaaagaaggttaaaaacagatagaggacgatcatgcttcatcctcctttccgccgtacctgtgcgcaagaaccatctggcggataatcccggaaatggcggcgcagatcaacaggatgattacatcgacgccgaagaaagctgatccgagaaacgccaacaggataataacagccgcaaagtttgtgcgcggacattgcttgccaagtttgagcacggcgtttacaatcagcacaacaacaccggcgcggataccgtcgaagatccaggcgagccacttgatctttttatactgcataatgaacagcgacaggatggagataacgaggaaggacggcagcgtgacgccgagcgtcgcgcacagcgcgccccaaaagccggccacacgatggccgataaaggttgcggaattgatcgcgaccgggccgggcgttgattcggcgatggcgagcatattcagcatggtttcatcgtcaatccactggttgccctccaccgtttcacggtggatcaacgggatcatggcataaccgccgccaaaggtgaatagtccaatcttaaaaaatacaagaaacagcttcagatgaattggcatgtgcttcataaacaagtgatgtccttcccggggcaattcattcagtgcactatattgagccctgcggttattatacccccaaagggcgcgctgcgtcaaattttccgtatatttttagaaagaatgccataagctcttattgtggaaaaaattagggcttgcatgaaaacagatgcagaagggtatttctgattttctaagagcctttgataaggggaactgttatgtcgggatctttcagactcaaaccgctgttgatcgcgcttgtcataccacaggcggcggggctggccggctcgcttctggcgggtgatatgtccgctgtgtacgcggcgctcgataaaccgtcgtttgcgccgcctggatggctgtttggagcagtatggcctgtgttgtatctgcttttgggaattgcgtcgtggctggtctggcgcacgccggagaacgttgcccgcacgcgggcgctgaccttctatgctgtgcagcttgtcttgaatctgctgtggcctccgctgtttttccgcttggggcttctgcgccttgcattttgggaactgtgcgcgctgttggttctgacaattgtcatgaccgcgtgctttttgtctttgcaccgcatagcggggcttttggttgtcccttattgcgtctggctggtctatgccgccgccattaaccgcgcggttgcggcgctgaacacaggcttttaacagaatatgggatataaagcaaagaaggccccgggccgggaacggcccggcaggccaattttttgcagtcgggaaaatgggccggattgcctttgaaaagcccggcgcataatcacatttcaaacaagtcttataaaaagggattcctgctattcttttggagccggctgtggtatgataaatacagacaaccgccgcgtttggcagcggcgcatggacgttggaagggaataaaaaatcgatgaaactgaactttaacagacagcacacaaccatagccgtttacgcgtttcttgtgttggcagcggcgatcctgtttaacagcttattggacaactttccaagcgtgcgcgggcttgtatcaacagtcacgggcttattgatgccgtttgtgtatgcttttgggatcgcttacatcctcaatccggtgctcaaggtggtcgaacgtgtgtttttgcgccgcctgtttggcacgcgcattggcgacaagccgatgcgtgcgctggctatcctgttgacatatctgttttcagcgggaatgatcgctatctttgcgaagatcgtccttccgcagctcgtcttgagtatttcggggttgatcgcaaagatgacggcgtatctcaattccacggagacatggctgccaggtctgctggccctgctgggggattttgatatcagcgcgacgatcgaaacggcgcttcgtcagtatgccgatacgatcatgagttcggcgatgacgatgctcaagcaattgttcccgtggatgctgtcggtttcgacggggatcgcgtcgggtctattgacaattgtcgttggcattatcatctccatctatatgctgatggataaggagcggttctgcgccggcatcaaaaagatctggtacgcggtcctgccaaaaaagaatgccgattggattcttgacctcgcggcggaggcaaaccacgtgtttggcggctttatcggtggaaaaattctggattctctgatcatcggaatcctgtgcttcatcgggatgtcgctgcttggcatgccgagcgcgatgcttgtctctgtgatcgtcggcgtgacaaacgtcattccgtatttcgggccgtttatcggcgccatcccttcgttttttatcatcctgatcgacgcgccgatcaaggcgctgtggtttctggtgttcatcctgattctacagcagtttgacggtaatattctcggcccaaaaattcttggcgattcaacgggactttccgcgttttgggttatttttgcaatcatgctgttcggcgggctgtatggattcatcgggatgtttttgggcgtgccggtgttttcggtcatttatatgctgatccagcggtttatcgacagccgcctgtcagcgcgtgagatgccggtcgatatcgagagctattgtgcgccggacgcgcctattttgcgaacgtccgcgcaaaagcaggatacgcaggataagccgcgccgccgtggggcgcatgtgccgtatatcggccgaaaaaagacggattcggacacgcacaaggatcataatcaggaccagagttgaaaggagtattccaatacatgaagcaaaagaggtataaggtcatcgtattcggcgtcatcacgctgctgattgcagcatacatttttgttgaggcgccaaatctcaacccgtttttcttttcggacggcgcgctattctgggcggccgttatcacaatttatatcggcgcctgggcgctgatgcgctttggagagctgacattccagtttacagaccgcagcgcgcgggcgttcaattatgtgcccaaccgcaagtttccacgctggacaaaaatattgctggccgctccgtgggtattttatgtggcgcttctgatcggctcgtcgttcatttttcattcgaacgcgttccgcgatcagcttggagaatcggaataccgtgaattttccagcgatatgcaggcggttgatctcaagcaggtgccgatcgtcgatgaggagcttgcggttgtgcttgcggacaagaagcttggcgaacgcgcgggacttggcagccaggtgcgtttgggaacagacgccgtgactatccagcgtgtcaacggcaagctggtatgggcggtgccgctctaccattcaggtcttttcaaatggctgacaaacctctccggaacgcctggatatattctggtgtccgctacagatgtcaacgatgtgcagtatgtggaagattacagggtaaagtaccagcccggcaattatctgatgcaggatttgacgcgtcacacgcgctttttcggcgggtggttcgacggcttgaccgatccatcctttgaaattgacgatagcggccagccctattgggtctatacgacctaccgcaacctgcgcggtttttcgctgccggaggccaccggcgcgtggatcgttaatgcgacgaccggagaaatgcataaatatacaattgataccatcccggagtgggtcgaccgtattcagcccgaatcgtttatcctgacacagatcaataataaaggtgagtttgtgcatggatggctcaactttgcggatcgtgacaagttccgcgcttcgcaggggcatatgattatttataacaatgaccgctgttacctgttcacaggaatcacaagcattggcggcgatgatagcgccatcggatttatcatggttgatatggtgacaaaggattcgatcgtttaccagatgccgggcgcgacagaggaggctgcgcagggttcggcgcagggcaaggtgcagcatctcggctatcaggcgaccttcccgctgatccttaatatcgacgggcagccaacctattttatggcgctcaaagaccgcagcctgcttatcaagcagtatgcgttcgtatcggtcgaaaactattcgatcgtcggcacaggcgagacgattgatctggccctgcgcgactatcagcttggattaaaaaattccggtatctccacagggggcagcacgaccgcccagcttcaaacagcaaccggcgtggtgctccgcgtggcgtccgaggttgacggcggagagacatcgtataagctgctgttggaagatcggccggggcagattttcatcattcctgcgatggtgtcggatgagcttgcattgacacgcgagggggatcgtgtcaggatcgaatattccgctcaggagggactttctaatcagtcgactgcgtttgataacctgtcgcttcctgatgcatgagaaccaaattgtttgcgccgggggatatatcccccggcgccatttgctgcggatagaagctgtgccgatttgtcattgcggatcaaatatcaaaaaatggaaatatgcataaaatttattagagtgtcgcggcaaaatcaaacggaaattgagaaagtgctctttttgaaacagcctacaaaaaacgcattgacgcggatagatcatcggattataatagggtcagaaatgaataattctcattttgaggatgatgcagtctgtgtgaatatgaagctgcaccaattgggggaagtacctggattgcgtaaaaattttttgactggcaaggaaggaaagcgtaggaactctggcggatttcaagcttttttgacgcagttcagacgtagatttttccgataaggcgtgtgcgtctcccttggtacagctttttctaagcggcaaacagcggatgcccatctgttgagcctggggctgtattttgaaaccgcaagaggaagcagaccgccggttattttctgggggaatggagcgcgtcatttgtgcaaacggacaaaacggatagttcagaaggccaggggtgagacatatgaccatattatccgggatcggttcgtcccacggcattgtggccggccagatccatttttttgacaatgccgcgaaacctgaaaaagcgcgcaaggcactggatcgcacagctgaaaacgagcggtttgaacatgcacgggctgccgccgttgggatgctcggcgaattgcgtgagcgggccgccagggaggtcggcggcgatgaggcgatgatttttgacacgcagcggatgattcttgaggatccggattttatcgatgcggttgcaaaattgattctggaggatggctataccgccgaatatgccgttcaggaggcgggacatcgctttgcccgtgttttttggaggatggatgatgcttacctcagagagcgcggcgccgatattgttgatctctgcaacggcctgatccgccagttgcgcggccttaaggaacaggagctttgcgaagcgcgcggccaatgggtgatcgccgcgcaccgttttctgccaagcgaggtgatccgcctcgagcgcgggcgcgtgctggcgattgtcaccagtggcgggacgcgagattcccatgcgtcgatccttgcgcggaccatgggagtaccggcggtagtcggcgtcggcaaagggctgtttgccctgcgtgaaggggaaatttccgttgtggacggctattccggtcgcgtatttatccatccggatgaacggacgctgaaagctgtgagggaacagtgtcatggaccgcgtgttttgatacctgcgattgaatgataaaaaccgttcgggctttgcccggacggtttttctttttcaggtcttgacataagtctgatttcggactatactatccaatacattaagtacgaaatcggaccaggggaagtgtttgtgtggaagataaaactaatgaactgctgagagcatttaaccggattgataaggaattggacgacgtatatcatgaagttgctttaaggatgaatatttcggacagtgcctttactattttttatattatccatgagcttggggatggatgtctgcaaaaggacatttgccgggaagcgtttgcaaataaacagactgtccactcctccatccaaaagttagaacgggaaggttatctttacctgcaacaggggcggggacgggataagcatatttgtttgaccaaaaaaggaaaagaattcgtagaaacgaatattgttccagtcgtccaaaaggaaaacgaggcttttatgtcattattgccgcaggaacaagaggagctgctgcggttgacacaaaagtatataaaaagcctgaaggagaagctgaaacaaagccagctttgatttttaacggcaaaatcattttaggcttgtttgaaaatagagatattgccggatttttcgcaggcagcattcgccgctgtttgcagaaaaaggcgggaattttgaattttcaaacagcccctgggaggattatttacaatgaaaaccatcttgcggtttatgaaaccgtacaaatgcttatgcttttttaccttgcttgtgatggtgctggatgtcgcgggcggcctgttgattccgaccatcacagccgacatgatcaatgtgggggttggcggaggagatatgcagtatttaatccgcagagggatacacatgctggcgatcactctgatcaccagccttggcgctctggccggcagttatctgagcgcagatctttccgcaaaaatcggaagggatatgcgaaatgcgctttatgacaaatcgcttgcattttccgcggacgattttgagcaatttggaaccggatcaatgatcacccgcacgcttaatgatgtgaatattatccaacagggtgttgtttggttcatccaaatggtgttgccggtacctgcggtctgccttatgggcatcatcatggctttttccatcgacaccatgatgggcttcctgcttataggcgctacagtttttgttattctgctggctgttcttgttacaagaaaggcgtcccttatttttgaccgcttgcagggctttctggatcgaatgaatattgtactccgtgaaaatgtaacgggcgttcgtgtcatccgcgcttttaataaggagaaatttgaagaaaaacgcatgaaaaaatcctttgaggactatgcggaatcggcgatccaggccaaccgcttattcgccggtcttgagagcgccgcactgtttgcgatcaatctgtgcattgtattcatcctttggctgggtggaaatcggattggcgcaggctttatgaaaattggggatattaccgccctgacacagtatgcggttatgatcctgttttatatcatcatggcacagatggtatttatcctcattccacgggcgatgatctgtgtccgccgaatttccgccgtactgtaccatacgcctgagattgaggacggcccaaccgccgcctgcgccctgaaaacaggattaaatgaggtggtccgctttgatcatgtaagctttcggtttgcggatgcggatgaagataccctaggggatttaaattttgcctgcaaacgcggagagacaacggcgatcatcggcagtacgggaagcggcaaatcgacgattgcgaagttgattttgcgttttcacgatgtcacctccggatccattcttttcaatggttgtgacatccatggaatgccccaggcggagcttcgggagcgtatcgcctatgtaccgcaaaaggcatggctgttttcaggaacaattgcagataatctgcggtatggcgatcgaaacgcggacaaaaagcagatggagcacgctctgcggacggcgcaggccggctttgtaagcagcctgcccgatggcctgtatgcccgcgtggcgcagggcggcacaaatttttccggcggccagaagcaaaggctgtccattgcgcgggccttgatgaaaagggccgacctgtatatttttgacgacagcttttccgctttggattttaagactgacgccgccctgagaaaggccctgaaaaataagacggcgggcgctgcggtattgattattgcccagcggatcagtacgattatgaatgcggagcaaatcattgttttggaggatggaaggattgccggcgccggcagccacgcggctttgatggagagctgcccggtttatcgcgatattgcaaaatctcagatgaaaggagaggcttgtgatgagtgaatataacaacagcatggacatcatggacgatggaatgacttttgaaacgccggcgcatgcaggaagaacgctgaaaagattgtggcgttttgtaaacgaccaacataaacggttgacgattgtccttgtatccgttgttttttatacatttttatcgatcattgcgccagcctatagcgcgcatatcgtcgatctgctttggaacggcatcaaggccgctatcacggatggtaccgcgtttcgcgtgacatgggcggatggcggcagagatattttttacctgctgctgatctatctggcgacagcactcttttatacgctgcaagcatatctgatgtccagctttgctgagaagctgagtctgcgcttgaggactgaaatcagcgcaaagctcagccggctgccgctctcttttttcgaccggacaaagacaggcgcggtccttagctggacggtcaatgacctggataaaatgtcggaagcattgcagaccggcctgctcaagctttttacagctgccggaatggttgtaggctcgttgattatgatgttcaggttcagcgtttccctgaccctgatcttcatgttatttacagggatcgccttgatctccatgaacctgttttctgcaaagaccctgaaatatgcgattgaaagacagcgatgcgtcagcaatgtgacggctcatgtggaggaggcgtacagcggacgcgtgatcattaaagcctttaatcaggaggaaaacagctccgaaaagatgcacagggcgacacaggagctggccgaatccacacggaaagcggagtttatgatcaacgccatcaatcctgccattcgtttgatcaaccgctttggccaggtattgatagctgtccttgcagggaaaatgcttttggatggcatcctgactgtcggcgtgttccaggcgttttttcagtatgtcaaccagtcctcagagccgctgacagaagtcgcttatatggtcaacagcatgcagtccgcgctggcgtcgcttgaacggatttacgacttgctggacgaggaggagctttcatcagagccggcagcgcctctgacggttcatgacgcagagggaaaagtggagtttcaaaatgtccgcttcggatatactgcggaccggatgctgatgcgcaatatcagtttttccgtaaggcccggacagaaagtggccattgtaggcagcacgggtgcgggcaagacgacgctgatcaatctgttgatgcgtttttatgaggtaaacggagggaaaatacttctggatggaatcgatataaaggacctcacccgttccaatttaagaagcaatttcgggatggttttgcaggatacctggctgttcggcggaacgatcgcagagaacattgcttacagcaagccggacgccacgcgagcggagatcacagcggcagccagggcagccagagtggatttttttgtccgcacgatgtcgcacggttacgatacagttttaaccaacgacgccgaaaatatttccatcggccaacggcagcttttgacgatcgcccgcgtatttctctgcaatcccgctgtcatcatcctcgatgaagcaacctccagcgtggatacccgcacagaggtggagattggaaaagccatgaaggcgctgatgaagggccggaccagctttgtaatcgcccaccggctgtcgacaattgtggatgctgatttaattctgtttatgcaggacggcgacatcattgagcagggaaaccatgcgtctctgctcaaggcgaagggcgcttatgccgacctgtattacagccaatttgcatagaatacacaaaaccgtttgtgtttgccggatctgattttataaacaaaagccggcccatccgcttgtgccgatgggctggcttttgctatgctatagcggctttttgggcgatatgcgtagcagattgaaaaaccacaggcttcaaagcgcgctcgcaagaacgtcccggttcgcggcggttacagttatgagccggacatttggatgcgtttcaatctgatgcagaaagcagctttctgcgcgctgaagaactccgagaatctgtacaggaccattcaaggctgcaagcacagcttgccgaaagtccacggcttcctcctcgtggggaccgatctcatccatgaccagcagacgtaccccgggacggggcgtcagggcggcacatcccagagcattaaaccgggcggctatcgacgcctggtccttctgcgcgccgcaacaaaaaagcaggttatccgcacatggggagtcccgcattcccacgcgcaacaaatgaactgtgatttggccagacagaacaccggcgctctttacagtgaagaagccgccaaagggaccggggcttcgctttaggagcactttaatcaaactgcttttaccgatgcccttctcgccggtaagaaatagatgctttgtcatatcaaaacctctgaactctgtgataagcaaccgacgctttgcagcgattgttttgtgcatctgccctcccagcgtctggcacattctaatcaaacggcgctgcgggcaggggtgaagtgcaggagcaattgctaatcggttgcgcttgcgtttgaaaaaacaaccatgctttccatcagaggccaataagaaagataaacgtccgcagccttgtaccctgataggaatattttctttattatagctggtttttacagcgtccgcaatcgctttctagatgcttggttttatcccctttgtaccataagagcgcggcggaatcgttctaagtactgcaatagttcctggattttctgcgaaaggtgcgctgaaaaattgtgagatccttgtgagatttgccgggatggaggatttatatggtatcataaccgcagagcggttatgataccggggttatgcccaacggctcgccgcttgggcggcaaccgcctttgatgggcaattataccatgatgatgtgtgaatataacgggatatcttcaaaaggcacagagggggagagtcaacatgccgaaacttttgattacagacgacgacctgcatctgcgcaagctggtgcgcacctatgcggaggtggacggatatgcttgcgaggaggctgaaaatggattccaggctttggaaaagctgcaatgcagacagtttgacctgatgattctcgacattatgatgccggggatggatggctttgagacaatggcggagctgcgaaaattcagccggatggcagtaggagcggcgcgcaaggatgtgacggatgcttacggcgagccgacaaaacaggacggcggcctgcttgtttaccgtgcgtcggaacgcgccggggagccggcctctgcttcgaattggaggaggacgaggacgcggtgattgcgatttttctggctacagaacagatttaggagagaggacggatgttggtcctggagaaaatcagggaatatgcaaaaacaggacgcacggccctcattaaccgggatgaacggatgacgttcgcggagcttgacgcgcgttcggaggcgttcgctgcctggctgcttggatggtttggaaacgaccgggcgccggttgttatctgtggggagaaggagagcaatttcctgcttgatgtctgccgggaaaaggggattaaaccgctgttcattcatgtgcccctttatggacagtggagcgactacaccggctttacagcggaccggcgggcggaatattatattatgaacatgtacggtcgattgtgggggaatatggcgtaaagctgctggacctgacaggatttgaatatgagccgtattttatgtgtgacacgatgcatataggctggaaggggtggttggcggttgatcaggcgcttatcagctattattacgaacagtaaggtatggcttttgtcccataccgcggcgcgttgcggctggtatctgtttgtactcacggcgctgctggtcttttggttctgcacagacggcggtgaaatcgcatttgtttacaatgcattctgaagcatatctgtcgtttgtaaacggaaccggtcctgttgatcatgcagccattccaggccgcttgatcattagggctggtttccaattagggtttgtttgaagcagaggaatcgccggattttttcgcaaacagtattcgccgcggttttcagaaaaaagacggcaattttgatgtttcaaacagcccctaggtatctgttaaaaacgcgccttccttttcaaacttgccacgcaggatgctgatcgcctttttctcaatccgcgatacataagagcgggaaatatccagcttttttgccacctcgcgttgtgtaagcgaccgtgtgcctcctagcccataacgcatgatgatgatctgtcgctcccgttcgtccagcgcaccctcaataaaccgatacagctgttcggacttgatccgcaggtcgatacagtccacgatattgtcatcctcggccatgatatcctgaagtgtcagggagttgccgtctttatctgtatcgatcggatcgcttatgtaaacatcctgggcggatttcttcttattgcggaaatgcatgagaacttcgttttcgatacatctggatgcataggttgcaaaacgcgtgcctttttcgggtttgaatgtggaaaccgctttgattagaccgatcgtaccaatggagataagatcgtcctggtctttaaaggcgctgtaatatttcttgatgatatgtgcgaccagacgcaggttatgctctataaggcgtgtttttgcttcttcgtcgccccgagcaattccttccaggcattcgcgctcctctttggcggacaaagggcgtggaaaggaaccagtcccggtaatatgcagggcaaaatagatcagattacaaaatgcttcgaataaagaaaacatgagaacctccttgacggctgattttgcccgcgttcttttttgggcgaagggcgcagacagagcaataacaaatatatgctccgtcagcttatccggtgcaggtccgtcggaaatcgaggactatcagaacacgtccataacagaacctgcgccggtcgcttcggatataatcacatgattttaaaaagcatatgagcgcttcctgatagcgggcgcccggaactgtttgcatgaaccggaaaatagtggtatactgaatacaaaatcagtttaattatgatttggtgagaacacgtataaaggagcctgcggatgggacaagctattttctgggtactggcggcgcttaatttggcgggcttggccgtttgctttgtcgataagcgcagggcgaagcgcaaggcttggcgcgtgcgggagaggaccttctttctgttggcgctgctcggcggcggatggggtgtttggggcggcatgtacctgttccggcacaagacgcgccattggtattttgttattggaattccggcggtcactttggcggaatatggttttttaacctggtttttgctgcggcggtaaaggctgcacagggcttttcaggaggaggaaataataatggcaacacgaattggcatcctgacagcgggcggcgattgcccgggactgaacgcaacgatccgcggcgtcgcaaaggcgatgtatcaaaagatggacgatgtggagattgtggggatcgtcgacggctttaaggggctgattgaaggcgaatatcatgagatgaagcagtccgatttctccgggattctcacgcgcggcggaaccattctgggtacagcgcgcacgccctataagagcatgaagattgttgaaaacgatgtcgacaaggtcgcgcgtatgaaaggcaactataaaaaaatgaagctggactgcctgatgacgctcggtggaaacggcacgcacaaaacggcgaacctgctttctgaggagggactgaatgttatcggactgcccaagacgatcgataacgacatttggggcaccgacgtcaccttcggatttcatacagccgtcggacttggaacagaggtggtcgaccgaatccatacgacggccagcagccacaagcgcgtgatggtcatcgagatcatgggcaacaaggtagggtggctcacgctttatacaggcgtggcgggcggcgcggatgtggtgctgatcccggagatcccttatgatattaaaaaggtggtcaaagcggtcgagcgccgcgcggcaggcggtcacggtttttccatcgtctgcgtggcggaaggcgcgttcgacgtggaggaggccagactcaaaaagaaggagcgttcagaacggcgcgcggcagccggcgagacgacagcctcggcgcgcattgtgcgccagatcgaggaaaccagcggctttgagacgcgcatggttgttccgggccactttatccgcggcggcgcgccttcggcgtatgaccgcgtgcttgcttcacagttcggcgtctatgcggctgatctggtcagtcgtgggatatttggcgttaccgtagcgatgcagaacaatgtcgtgacgcacaatcttttgtccgatgtggccggcaagacaaagtttatcccgaccgacgaccagatgatttttacagcgcgccggctcggtatatcctttggcgattagggaataccatgaaaggatgtgcgaaggctgtggatggctggaagtttttttttcaaaattttcccgcgtgcctattgacaaaacgtccgcaatagcttataataaataacgcgctgttcaagaaaacagcgcaatctggcccggtagttcagctggttagaacgctagcctgtcacgctagaggtcgtgggttcgagccccatccgggtcgccagttttgcctttgtagctcagttggtagagcagaggactgaaaatcctcgtgtcgttggttcgattccgaccgaaggcaccatttgcgggtttagctcatctggtagagcgccaccttgccaaggtggaggtagcgagttcgagcctcgtaacccgctccaatgaaaagaggccgctgttcatcaacgcctctttttccatatacatatgtatatgggcgcggcgccatagccaagcggtaaggcaggagtctgcaaaactctcattccccggtccgattccgggtggcgcctccaaaagaagccttgtaaatcagcatttagctgatttacaaggcttcttttttttcgtagtaggatgcatgggagatttttgctttccgttcgtatagcaatcaatacaaacatacgtcctgtaaaggggaagatctcattgaacaaatgctccactgaatcgccggcggcatttatgcggcaggacggacgttttttacacggcgttttcagccggtttttgttcccgactgtcttgtctgttttaggtggcacggtcaacgtcatggtcgacagcgcgatcgttggcaacatgatgggagcgcaggcattggcggcgattaatctgtgcggaccaatttttctgctctgttcgacagccggctcgctgatcggttccggggccggacttttggcggccgcgcagattgggcggggagaaagtgaaagaagctgtgtctgctatacgctgtgcgtggccttgcagtttttgttcgggttcctgttgacgataggcggccttttgtttttacggcctgtcgtcaggcttttgggggcggacgacacgctgttcgcaatggcgctttcctatgcacggattgctttttggggcgctccagtgaaatgtctgctctatgtaccgtttaattttctgcgtctggatggaaaaccggctatggtgagcgtttcccttctcgcgatgaccgcgctcaatggcgtgctcgattatcttctcatcaaagtcggatggggattggcgggcgcatcgctggccagcgtactcgctacctgtttgggtgtggcggtcggatttgtctgcctgcacggcggcagcttccgtctgatcgtgccgcatggcggcgcgtcaattctgcgcgagctgctcgtattggggacgccgcccgcgctcaacaatctattgtctgtggtacggatgattctgcttaaccgcatcctgatggcggcagggggcagtggctttgtagctatctttacggtggtcggaagcgtcagcgactttaccctttgtgtgatttcgggcgttccgcagacagcttctccgctggtgggtatctatagcagcgaacgcaacaatccggggatgcggctgctggtacgcatgcagctatgctatggcggcgttctgatcgggggcatggccgccgcgattatattggcgcccggcctaatctgtacgctgtttggcctcacgcaaactgcacaggctgtttgggcgctgcgtctgtttgcgctgtcgctgccaatggcgatgctgtgcagcatcctgatctttttttataatgcaagcggacaggtgccgcttgcaaatggggtgaccgtctgccgggtccttctgtttgcggttattcctgcgtttgttttgagccgggcaggctttcctgtttggtggttttttccgctctccgaactgctgaccttggcggcgctttttgtggcgctgtggcggaaagcacggccggatacgctgcgatctccgattcttttgctcgacgaagcatatgaccgcatgggcaaggtcattgacttctcggtggaagcgcgggctgatgcggtagggcgggccgctgaactgatcggcggcttttgtgaacaaaataacctgaccgcccggcagacgatggccgtgagcctttccatcgaggagatgctcacgattatgatgaagcattgctttaaggagcagagtcaagcgactgtggatgtacgtgtgtttgtcattcaggggaaggttggcctgcgcattcgcaatgcgggaaaacagtttaatccaattgattattatcaggcgcatcaggcggcggacgagatgggcgaagctcttggcatccgtatgatcttaaagctggctcaaagcgtatgctatcaacgtacgtttggggtgaataccctgacgattctgttataggaggataggtatgggacaacagcatacgcagatagccggtccggtttcgattgtggatggggacgcggcgttttacaaggacattcaacagctttgcgatgagaggtacggaacaggctatttgcacagggatgattttgtacattggttggagcgtccgagacttttgaagatcgcactgctggacggcgaatttgcaggctttgcggtgatgatccccgcaagcgtcgggctggtcatgaagaaaatggatatgccgcgcgcagatgttttaaggatttccggggaaaagccgtccctgatctataaaagtgcggcggtacaaaagcggttcgagcaccgcgggatcatgaaggccatggcggacgccggcctgcgcgaagccagggcggagggatttggtgcggtttacggttcagcctgggtttgcaacgggacgctgcccattgaggggacgttccgtgcattcggcttccaacgcctttacgagcgtaaaatgctctggtatgacgacccggattatcactgtgttgtctgtgggggaagatgtgcctgtgatgcggtaatttattataagaagctgtgagggatggagttggaaaaaagaaaacggggtcttgggtggaaaataacggttctctgcctgctgttggcaggaattatttgtgcaagcgtttgtatcagcggctatcatcagtaccgtgcttcaacctttcggacatataacgactttgcctataagctggcggcgacagctcttgcctatgtagatggaaaccggatagccggttatttggaaggcggcggaacggacgcggcttacgacgagatggaccgtcagatttatacgctctacaaaaataccggtttgacgagcatttatatttgtgtgccggacgaagccgcgatgacggtcacaacgatctatgatgtacgtgtccatgacgcgcaaaatccccaggcatatgctctgggtgtggtcgacccgatcggaagcgacgacccgcagaaggtggtggatgtttaccgaactgggaaacggccggatgattatttcatccgtaaaaacagcttcggctacaacacctccgccattgttccggttcgaaacgacgcaggagaggtcacggcgctgcttctggctgacctgcctatgccgtttatccttgaaaatctcaatgcatacctgctttccacagttggaatcacagtcgtgctggtttttctgattatatttggatatctgcgctttctgcaaaagcgtgtcgttatgccgattcagtttttgacgaaaaacgcggaggcgtttgcaaaatgccgcacaggttttttggatgaaatgctgaacattcataccggcgacgaaattgagacactggcggccgcgttggcaaaaatggaggtggatatcacaaaatatatcaacaatctggcaagagtgacggccgacaaggaacgtattgcaaccgaactggcggttgctacgcagatacaaacctccatgctgccatgcatctttccgccctatccggatttgaaagaatttgatatttatgcgctgatgcaggccgcaaaggaggtcggcggtgatttttacgattttttcctgatcgaccgcacccatctgtgcgtggtgatcgcagacgtttcaggcaagggcgttccggcggcgctttttatggtcattgctaaaacgctgattaaaaaccatgctcaggcgggtatgagtcccaagcaggtgtttgaagctgtcaatgaccagctttgtgagaacaacgaggcagggatgtttgtcacagcctttatgggcgtgttggatgtgaccgacggcagctttacttatgtaaacgccggtcacaatccgccgctgctttcaacggggggcgcgccctatgattggctgaaatcaaaacgtgggtttgtattagcgggaatggagcatatgaaatacagtcagcagcagattacgctttttcctggcgacagcctgcttttatacaccgacggcgtaacagaagccctcaatccgcgcgaggagctttattccgaggcgcgtttaaaagcgtttgtaaattcgggcaggttggacggctgcacgctggagaaacagctccacctgctgcggcaggagcttgccgtttttgcagacggcgcgcagcaggctgatgatatcaccatgttgattttgcggctcaatgagaaaggggatcaaaatggctgaactgaccgtacctgcaacgctggaaaatttggagattgtaacaggatttattcatgaacggttgaagctggcaggttgtccggcgaagcttatgacgcaggtggatcttgctgttgaggaaatctatgtcaatattgcacactacgcctaccatccaagcattggcgaggcgaccgtttgctgcgaggtagggggcgagccgcttcaagtgacgattggatttgccgacgcgggaaaaccatacaacccgcttgaacaaaaggacccggatatcatgcaggacgctgatcagcggcagatcgggggcttgggcgtctttatggtgaaaaagctgatggatgaaattacatatgaatttatcgacggcaaaaatgtgctgacaatccgtaaaaggatgtagagaaatcagcccgattcgccgaaaaaaccgcaaaggcagatcgcttcaatctgcttttgcggtggtgtccggcggttgctgcgcggatggagctgtatcgttttgaaaaatagagaatcgggcacgcaggtttttcagaaaggcctgctgtgtttcccgaaagtgccgctggctgaccggcacctcgcgcccgtcctccaaatatgcgcggtagcggaccaaccgcacaacattgtcaagattgatgatgaaactctgatggcagcgaaaaaattcggacggtaagagcggctcaagctccgaaattttaccgcgatagtaatggacgccgccttggtgccagacggctacctgtttgcccttgatctcaaagcagtctattttccaaagagacaggctgtgaacagtggaaccaatttttaatcccagatatcgctttttataatggttgcggtaatcgtagagcacggcagcccgcagatcctcagaagacaccggcttgaggagatatttaattgcctgcacatcgtagccctgcaaaataaaatcggggctggaggacacgaggatgatgctgacctgattgcccatttcgcgcagccgggcagccagccgcattccgccgtcgccttcgcccatcaggatgtcaagcagcacaagatgtatctcatcctgtgaagcgcacagcgcgtcataaagctgcgcaggttcgaaataggttgagatcctgcacggaatgttagactgtgccgtcaatgtgcggatctgatcggcaattccggcgacaaaatcaggctcgtcgtcacagattgcaatgtgatacaactgacatcccccccttttttttgtaagaatctgtgccggcggtttggctttccatgcggcaggatgacgcaatcatccggcggctgcaaacggcaaagccgtttgcactgcgcatattataccatatcatccggtcaaaaaaaagtttcgaaatggccgcgcagattctgcggtattcaaaaacggtaaatatttattaatttcggtcgttttgtgattaatttcatcacccctctttttttcatgtcgaataaaaggataaaatagaaatggttgcttctatacaaagaacagccgctttgagcttgtttcaggtccgctggaaaatctgttttgctggttcatttttcaagtggtctgtcgaaaaatggaggggtctggatggcgaatgatacgatcgatctggaagaactgtacaggagctatttcccgaaaatttacaacttctttttttataagctgctgcacagggaggatgctgaagatcttacagctaagacctttttgaaaattgcggagcatttgcatacatatcattctgagaaggcaaaggccggtacctgggcctggcggatcgcggaaaatacactgatcgatttttaccgtacacaaaagcgtcacctctcaacagacgacgaacaggaggcccttgcccaggcgctcagcgtgtcctttgacgagcagtatgagcagatcgcaagcccaaagcgcagggcgctttacgccgcgctgcggcagcttcctgagcgggacaggatgctggtgtgctataaatacctgctcggatggagttatcatgaaattgcagagaagctccagatcaacgaaagcacgctggcttcggctctccagcgcgccaaggaaaagctgcgcaaatacctcaaggatacgcagttttgacgccaagaggctccatcaacttgtcaaaggagcatatatccatgactcaaatgatttttcgccggaaaagcctggagcgcatcgcatcgcccgatcagcttgaccggtacctgcaagtgtccgcgccttcgctgtggctgattctcctggcgttgtttttaatgctgggcgcagccgcagcctggtgcttttggggcagtataccggccacaatttctggaaccggcgtccaattggaaacaggggcggtatgctttgtcgcggctgacaaagcgtatatgcttgaaccggaaatgacagcgcatctgactgcaagcggtacggatgaggtgtggaatggacggctgctctatgttgatgagcctgtccccgccgaacaggccgccaaaacagtcggagctgcttggttggcacagtccatgcctgcggattgggtctgcgttgttccggtagagctggagggcgcgccagccaaggccggcgctgttttcagtgcggacattatattgaagcatcaaaggccgattgatctgctgtttggaggttgagcgtgcgatgaaccggattgcaaaagtaccggtggtcatgcagatggaagccacggaatgcggcgcagcgtgccttgccatggtgctggcacatcacggaaaatggctgcctttggaacaggtgcgccttgcctgcggcgttggaagggacggcagcaacgcgggaaatctcctaaaggccgcccgcagctatggcctgaaggcgcagggctaccggtgcagcttgtccggcgtcaggaatatgacctttccgttgattattcactggaattttaatcattttgtggtgctgtgcggctttcgaaaaagaacggcggtgatctgcgatcccggcaggggacgcgtggaggttcctttgcaggaattcgacgaagccttcaccggagttgccatggcatttgaaaaaacaaaatcctttacaccggccggccggccgcgcagcgtgttggcatttgtccgctccagactgcgcgggacgctcgcaccaatgatctgtgtggtggcaatcagcctgcttgcatcgttgtccgggctggcgccgccgcttttttcacgcgtttttcttgacgaaatactcagcggaaaaaatccacgctggctgccgctctttttgatggcgctgggcgctctggttgtattccaaacgattgtatcgatcctgcaagcggtttatttgctgaagctgcggggaaagcttgctgtttcggcaaatgcccggtttatgtggcatgtgctgcgcctgccggtggaattcttttcgcagcggtatgccggtgatattgcgcagcggcagcaaagcaatgaaatgatcgcagaaacgctgatttcccaattgggacctttggcactcaatctgggggtcatggcgttttatttttgtttgatgatccggtattccccgctgctgacagcaatcggacttacagcggttgtctgcaacctgttgatcacgcagtatacttcccgcaggcggaccaatttattccgcctgcgtatgcgtgatgcgggaaagcttgcgtcagcgacggtttcaggcattgagatgattgaaactatcaaagcaagcggcgcggagaacggtttttttcagcggtggagcggtctgaacgccagtgtcaacggagccgatgtggatgcggcgcagcttgaaagcggctcgggcgcgctcttgcaggcgctctccggtttagccggcatagcggtgctgttattgggcgcggccctgattttgtacggccgtttcacggcgggaatgctgttggcatttcagtcgtttctgacttccttcatggcgccggccgggtccctgctttctctgggccagcagatgcaggaaatgcgcgtttcgatggagcgagtggaggatgttgaaagctattctcccgatgtggaggctccggcggcgcaaacgccggcgccagagggccttgagaagcttttgggcggcctggaactggatggcgtgacgttcggctattccaggcttgcgccgccgcttatcgagaatttttccctaagcctgcgtccgggcggctcagtcgcgtttgtaggtgcgtcaggctgcggcaaatcaacactggccaagttgatttccggattgtatcagccctggagcggggagatccgctatgatggacgcttgcgccatgaaatcccccgtccggtgtttacaggctcgctggcggtggtcgaccaggatatcacgctgtttgaggacagtatcgctgacaatatccgtatgtgggaccggtccatcgaggactttgagatcattctggctgcgcgggacgcacagattcatgaggacatcgtagcgcgggaaaacggttacaatgcggtactctgcgaaaatggcaagaacttttcaggcggtcaatgtcaacggctggagattgccagggtgctggcgcaggaccctacggtcgttatccttgacgaagcaacgtcggcgcttgacgccaagacggaatatgaggttatccgttcgatccgggaacgtgggatcacctgtatcctcgtggcgcatcgtctttccaccattcgcggctgtgacgaaatcattgtgctggaggatggccgcgtggtggaacgaggaacgcatgacgagctgtatgctaaaaacggggtttatacacgcctgatttcgatggagtaaagaaaggaacaaggatgggcctgtttgatgatcaattaaaaacgcgtctggaacaggaccgcgaatcctttgcggacgcgcttgaggcgcttggagagtctgtgacgggaaaagcagcagttacaggcaaaaatgggagcttggaggatgctgtgcacgaaatcctgacttggtttggagcgaaagcgccggagccgccgggcctgatggatgattttaacgaccggctcgattatatgctcaacccaactggaatccggcgccggacagtgaagctggatggaacatggtggagaaaggcggccggcccgatgctcgcctacacggcagaaggcggcgcggtggcgcttttgccgcgcaggtttggcggatatgcgtggcgtgaccctgcaaacaggcggacagtgcgcgccagtgtgaaaaccactgggatactgactggagaagctgtctgcttttaccggcctttaccgttgcgggcgcttaccctgcgggatttatttctctttgcggttcaatcggttgacagatgggatctaacgctgtttttattggctggtctgctggcgagcctgtttgggacggcggtcccgtttgtgacgcagatcctttttgcaacagtgatcccgatgggcggtatggagaatcttgcgcctgttgggatgttggcagttggagcgctgttttcactggctttggttggcctgacgaaatcgctggctgtcgaccgtatcgcgcagaaggtgcggctggtagtggaaaatgcggccatgagcaggttgttaagcttgcccgcgcagtttttccggactcacaatgcaggtgaactgcaaaaccgtgtggatgcgttgacgcaaatgtgcgcgttgctgggcgacacggtgctgacaggcgtcataaacggcgttttttccatcgtgtatctgtttttgatccgtgcgctggcccctgcgttgttcggtccgacaaccgttattctattggcgcagcttacggttatgattgccggcgtactggcaaaagctcatgtggcgcgtaagcgcctgcatattgcggcggatttgaacggattggtgttccggttgttttcgggtattcagaaaattaaactggccggggcggagcagcgcgccttttcaaaatgggcaaggtgttatgcagagaatgcggcgctgctttacaatccgccgcttctgctcaggatacagccagttttatcggcgctgattgccttgggaggatctatcctgctttattcctcggctgccaaatccggaatgcagacagccgattatatggcgttcgcatccgcatacggcttggtgaatggagccatgttgtcgttggcttcgatgacagagggcctggcggcgctgaggccgctggctgaactggccgagccgattatgaaggctgtaccggaaaccggcggcaataaaaaacagatccacagaatgagcggcggtgtggagctggcgaacctgtcgtttcgttatgcacacgacgcgccctggattcttgaccatatcaatttaaaaatccgtcctggccagtatgtggcgattgtgggcaaaaccggctgtggcaaaagcacgctgatgcgcctgctgctcggctttgaaacgcctgtctcaggcgcggtctattacgacaaccgcgacctgcaaacgctggatttgcctgctctgcggcgcaatatcggcgttgtgctccaacagagccgtctgtttgccggcgatatctattctaatatcgccatttccgccccgtggcttaccatggacgaggcgtgggaggcggcaaagctggccggcatggacgaggatatcaaaaaaatgccgatggggatgtatacgctcatcggcgaaggcggcggcgcactttccggcgggcagcggcaaaggctgatgatcgcacgggcgatcgcttcaaagcccaaaattttaatgtttgatgaagcaacctccgcgttggataatatcacacagcggatagtatccgattcgctcggtcaactgagatgcacccgcattgtgatagcccaccgtctttccacgatccgccaatgcgaccgcatcctggtgcttgacgggggaaagattgtggaggacggcgcttatgacgagttgatcaccgccaaaggcctttttgcggagctggtcaggcgccagacgcttgatatggcgccgctgtaaggctgataagattttataaaaagccctgcttcctgtataagcagggctttgcctgtgcagccaaatggataaaacagatcattttgagctgatatccaagatttcgccggaaccggataggccttcaaagcctttggaccctggtcaggtcaatagcgttcggcgctcccccgagcgcggcgttgggaagctgcgatacctgcgtctggccgggtgatgcgggcaaagtggtcacatttgcgctatcctgctgatgacgatagagcaagttgtgcacagagccgtcttgcggcagaggcgccgtatatccgccggtcatctgttcaaggacatcgtcctccaattggacggttggctgctgctcctgctccgggatccttttcatgcgaaagcccccttttcatttattttatctggtttcgccgtttggaatgatatttagaatatcggaaaagccggtcatgtcgaatacctccatgatttcgtcgcatacgccgcgcaggctcatgcatacgccggccgccttgctctgtttttgagcggccagcaggacgcgcaggccggcggagctgacatagttaagcccggtgaaatcaagcagaatgtcgcaggaaccgtcaagcgccggaagcagaacgtcatgcagttgaggacttgtggtcgtatccaaacggcctgccaaagcaaaaacagccgttccatcccgactggttcggttgattgtcatagaaaagatcgtcctttcatttttttctgaaagctttattcctgagtatacatacgacgcggtctgcaaaatctcccgcaccatttatttgctttcggatgaacattttaaaacaactatttttaaaatttgtgggagatttcacgcattgattcgtattgataacttggagaggaggaggtcggggatgacatgcgatgcaagcagcgattttggactgacaacatccgattttgacttttccctggagtgcggcgcgtttaaagacgcattgcgccaggcatttatgcaggcggtaaatttgcagggggtagcgccgctcctcgacacagagcttgatgaactcaacgccgcgggggatggaatgcggccggaccagcagggaaaaaaccgatttgagatgcgataggtgatcgtgggtttacattgtgatcagccggtcaaatgtccaggggttaggaacgaattcaacagccataaggcgatatcggaaccgttttcggcgtgtctgttggcttatctctcaacgcaggcgccggcgctatgctggtttttatgggggagcgaagcggcgtccagcaagccgtatttcaaggcggaaaggctgtttgagtgccgtcattccatgatgtgtcctgaaaaatatccggatgattttttcaactgttcctgttttctggaaacaatggatgagatcaactggatgggctgaagaatattgggaataaaggggaaagcggggctgcgtccaagtgacgcagctccgctttcgtatagagagttgataagaggatgtcaaaagaattcaggcggaaccggcgctgcatcggatacctgcggctgttcgcgccggttgcggcgcagcagagaacgcttgccggttttatgtccctttttgcggcggtcctcgccgtcaaacagaagatagacggtcgggacgagaatcaatgtgacgagcgtcgaaagcgtcagaccgccgatcacaacgacggacatcgactgcatcatttcgacattgccgccgaagccaaaggccgaaggcagcaggccgaggaccgttgtcagcgttgtcatcaggatcgggcgcagacgtgaacgcccggaattgacgagcgcgtcatgggcggttagcccctgttcacgccgcagaatattggtataatcaaccaggacgattgcgttgttgacgacgatgccgacgagcataatcagtccgatcagggaagtcatgctgatggacatgtctgtcagcagcagcgccagaaatgcgcctgtcatggcaaacggcacagagaacatgacgacaagggagaagcgcagcgattcaaactggatggccataacgacaaacaccaggaaaattgctgtggccagcgcgccgtaaatagcgttgaattcctcgttcatggtgcgcatgctgccgccttcctcgaccgtgactccttcgggcagattcatctgtaaaacccgcgcgagaatctggccggaaagactgctgtccgactggccaatcgcggtctggcctgtaatggaaacctggtaatcgccgtcctcgcgctgaatctgagaggggctgttattgtatacgatggtcgctacatcggtcagcggaacctggccgccggaacgcgtggagatcatcaggccggaaagatcgctgacatcatagaagcggtcttccggatacatgaccttgacggaatattcctgatcgctctcctgaagcgtagtcgcctcaataccggaaatcatgttccgaacggtagacagcaccgccgatggggtggtaccgattgcggccgcctgcacagagtccacaacgatttgagcacgggggtcgccgtcggacaggcttgttgaaacggaatcaataccgtcaaattcctgcataacctctttgacctcgttggccgtttgttcaagcacatcgaggttgctgccggacagattgatctgtacaccccggctgccaaacgacatactgctgcgttcctccacttcaacgctggcattttcaacataagctgtttcctgacgcatcaaagcgatgaattcgtccgtctgcatggaacggtcgtctttgagcgtaacggtaatgcttgcggaaccgccgccgccgcgcatggaatagctttctacgtcgggctgttcggccaccagcgcctcgagctgtgtcatgatctgatccgtttcatcaatattaagaccggtttttgtcgtgacagaaatgctgatggagccttcgtcggacatcggcatcagctcggaatcgatctgagtgaacataacgaacgtgcctgcaagcatgacaatggcaatggccacaacaatcagcttatgacagagagccttgtcaagcaaggcgccgtacaggcgttcgagcttgtgcagtccgcggttgacagccgaagtttgtttttccacgggccggaactttgcaaaaagcaggggaacgagcgtcagcgcagaaatcagcgaggctgtcagcgaaaagacgatcgtaaagccgacgtccttaaagagctggccggacatgccgtccatcaaagcaatcggcaggaaaacgacgatggttgtgatcgttgacgcgatgacggccccattgacgaggttcgctccggcgatggcggcgtcgtcataggtgcgtataccatcctgcattttaaagcagctgtcgatgacaacgatagaattgtcgaccatcattccgatgccgactacaaggccgccgagcgagagaatgttgatggtcatgccaaacgcggccatcagcacaagcgccgcgaaaacagacagaggcatcgaggtggcgacgatcagcgcggcgcgccagtcgcccaggaatacgaccaggacgagcatggaaagcacaagaccctgaagcagggtggaaacgacgttcatgatgttttcatagatcgtttcgccgctgttgtttgtgatttcgattgcaagaccaagcccctgcccgttcaattcgtctactttctcggaaatctcattgcagatctcaattgtgttggcgctttggttcttcgaaatggacaggctgatgttatccatgccgttataacggctgatattgttcatctgctcctcggccatactgacggtcgccacatcggagatatggataatatcgccggaggccagagaaatcgggatggtttccaggctttcataggtgtcgtagctgacgccgccctcgagcgtcagggatatgttgccgcggttgatttcccccgcggtcgttgtgaagtcggccgaggcaatggcgctggagatatcggtcattgaaagaccgtattgctccatctcctcctcgcgcaattcaaccttgacatattcgcgcgtaccgccgcgcatatcgaccgatgagacgccggagattttttcaagttccgggacaacggtattttcgatataggaataaatattgtcgtcggcgttggcacggatggaaagatccatgatcgatgaagaatccatgctcatttccataatcgtcggatcatcggcggaatccggcaaacgcaggcgcgtcaacgcttcattgatttcgtcgtatttttcatccatatcggtgttgtaatcaaattccagggtcgtcatggacgagccttctgaggaacgcgacgtcatagttttaacgtcgctgatcgaggatagggccgattccacaacatcggtgacaaggttgtcaacctcctccggggaggctccctcgtaacgcgtcataaccataaacaccggcatggacatctcaggggtggactccatctccataccaaagatggaggagatgccgaataccaccagcatcagcacacacataaggaccgcaacgggcctcttgacagacagttttggaagcgtcatcctgtattagccctcctgacccggcgcgttggcgccgtctgcggcagagggcgtgctgtccgccgggacatcgccggattgcgtatcaggggatatttcatctgcggacgcttcatcagcagagctgctgctgtctgcgggcgcgccatccgccgggggcgtatcgtccgccaacgctgcatcgtcggaagcttcatcaccggtgccgcttgcagactggccggcttgtggatctgtctggccgttggcaagcgtgacagacgcgccgtccttgaggtcgggatgccaggttgtgatgatctggctgtccatatcaagcccggattcgacaacgacttcgtcgctgctcgtcatgccggtgacgatatcggtacggtgcgccgtgccgtccgcatatgtaaagacatacggctgcccctcgtcatagtagatcacatcaatcgggatgagcatcgcgttctcagccttctgcgtagcagccgttaccttgacggaaacgccggaaagcagcgccccatcggcgtcctgaatctgcgcttcgatcgggaacagacctgtcgattcatccgcctttgtatcgatagaggtaatgaccgcggtgtattctgtcccgctctttgtgagtgtaatctcgtctcccagggagagcgcgacagccgcgtcggcggaagcgttgaacttaaccgacatggtattcttgttggagatcgtataggcggccgtgccggtcgaggccatctcatacggtgtgaccgattttgtttcgatcacgccgctgataggggaataaaccttgtatttatccaatgtcgcggcgctttgctccagtgagagctgcgccgatttcagctcggcttcagtggcgcgctgcgtatcctccaatgaaccgccaagcaggaggttatagttttcgagcgcctgctcatagcttgtttgtgcgttcttataggagttgcgcaggtcgcgcgcttcgctgtcctcgctgtcctccagttcgttgatttcagaacgcaggagcagatattcctgttcggctttggtgaattcgtcaagcaagtccttgagggtatcctcatccgtattgggatcgttctttgcgtcctcatatgcctgttcggccgctttcatcgctgtctccgcctcatcgcggcgtttttccgcattaatcaggctgtcgtcgtaaccatcgttgtaatccttaagcttgagacgcgcgttgttcagactttgctgcgcggaatcaagctgcgctttggcggacaacagcttggattcatagctgcttccgagcgttgtgtcggctgaaatgaccttttgctcatagctggcctgtgccatttcataggagagggccgcgtcggtatcatcaagtgtaaacagcagatcgcccgcctgcacagtatcgcccgcttcaaaataaacctcgctgacctttccgctgatctccgggtaaacattcacgctttctgacggttcgattttgccgataaagtcggttgtgcgcgacaggctgccagtttcaggcgtctggagcttgacctggatcacactctccgacatttccacctggccgctgcccatatcgccgcccggtccgccgccgggaccaccgcccggacctccgccggcagcgaatacaacaacagtcgaaacagcgacggcgcccgccgccaccagaaggattccagttgataatttttttttgtccatcgatccaactccccaatctttggccgcagaggccgttttgctgtggttcattctacgggctgaatgtggggacaacacaaaaaaaatgtgaacaaattgtgtggaaaaatgaaacagtttatgttatggaaatgtgttggcttgggtgagacggccgttttgctatgcatccgcacagcaaaacagagagccgtttcccacaggaaacggctctctttgcacaccgccagcaatcccgcttacagcgcggcaaaaaccgcgtcgacagcttccagcgtcctttgaaaatcctcttttgtgtgcgcggtggaaataaacatcgcttcaaactgggcgggcgcaagatagacgccgcgctccagcatccctcggaagtaacgggcgtatctgcccacatcgctgcccttggcgtccacaaaggtggtcacgccgttcggtgtgaagaacggtgcgatcagggaaccgatctgattgatgctgacatcggtcccatgcgctgccgccgccgcgcgcatttccgccgcaagctctttggcgctgtgttcgattgagacatacagctccgggtgggagcgaatatgccgaagctgtgccaaccctgccgccatggccaccggatttccggacagcgttccggcctggtagacagggccgcatggcgctacctgctccatcagggcgcggctgccgcaataagcgcccacaggcatcccgccgccgataatcttgccaaaggtaacaagatcggccttaatgccgaaatattcctgcgcaccgccgggcgccagacggaacccggtgataacttcgtcaaagacaagcagcgcgccgtaccggtcgcaaagagcgcgcaatccctcaagaaagccgggagaaggcgcgacgacgcccatgttggccgcgaccggctccaggatgacacaggcgatctgccccggccactcgtcaaagagggcctccactgtatccagacgattaaattgggcggtgagggtgtgtttgacgatgtcctcgggtacgccggcggaggacggatgtcccccggccagggcagaggaaccggcattgaccagcaggcagtcgctgtgcccgtggtaacagccttcaaatttaattagcttatcccggcctgtagccccgcgtgccagccggatagcggacatgaccgcctctgtgccggaattgaccatgcggaccatctcaatattggggaccatgtctaccatcagctcggccatttcaacctccgcctcagtgggcgcgccgaaggacaggccgtgctgcacggcctgttccactgccgcgcggatagcgggatgattgtgcccgagcagcatgggaccccaggaacagacatagtcgatgtacttcctgccatctgcgtcatagatataaggcccgtcggcccgttcaatgaaacgggggcagagatccacggcccggaaagcgcgaaccggggaattgacgcctccgggcagaaccctttgggcgcggtcaaacagcttttctgaacgcagcatcagccgatatccccctttcgcatggcctgtgcaagctctttggcaaagtaggtgatcagcatatctgccccagccctgtagatggacagcgcgctttcacacatgatccggtattcgtcgatcagtccggcagcgccggcggccttgatcatagcgtattcaccggagacggagtaagcgcacatgggcagatcaaaggcatccgagcactcccggatcacatcgagatagctgagagcaggcttcaccatcaggatgtccgcgccctccgccgcatcgagcgcgcattccttaacggcctccctgcggttgtgagggtccatctggtagcctctgcggtccccgaacgcgggggctgaaccggccgcctcccgaaaggggccgtagaaagcggaggcgtatttggcggagtaggccatgatggggacgtttgaaaagccgtgcgcatcaagagaagcccggatggcagcgatacggccgtccatcatatcggaaggggcgaccatgtcagccccagcctcggcgtgggacagggctgttttggaaaggacctccagagttttgtcgttgtctacgtcatggccgcagagaataccgcagtggccgtggtctgtatattcgcacatgcatacgtctgtaattacatagaaatcgggatatttggccttgatggcgcggatagccttctgtacaacacccttgctgtcccaggcggaggaaccctgcgcgtcctttttagccggcagtccaaagaggatgcaccggcctacgccggcgtcaatacaggactttaccgcctcatcgacagcgtccagcccatagtgaaactggccgtctagagcagggatggggcgtttgccgctgagggtttcgtccacaaaaacaggatagatcaggctgtcaggagacaggcgcgtttcccggcacatacggcggacagcgttgttttgccgcagacggcgtgggcggttgatcaggtccataacaatcagatcctttcaaaaaaggcgggcgcagctttggcgcgcccgccgcttttatacatggagaatggcatctaccaacgcgtctatgtcggctcttttggccacaataaccggaataccatgatgtttggcctcggcagcggtctgctcgccaatacagacgcccgtaatccgggagaagtcgcatgcacccactgaggcggcgaaacctttcaccgtggatgcgctggtgaaggtaacaagatcgagctttccggactggatcagagccttcagactggcggcatattcgctttcataaaccgtggtataacagtggatatcgtcataagaaatcttaccgcgatcgagcgcctctgtcaaggccggggaaccaagctccgcccgaaggatgagaacccggccggtgcagatctcagcaaggcccgcccccagatgggcggcgtcgtagactgcggggatataatccgcccgcaggccgtgtttacgcagttcgcggtccgtccccgttccaatggcagccagctttacgccgccgagcgcgcgggcgtccgagccatgccgctccagcatatcccacaggcagccgacgcccgcagggctggtgaaggccagatattcatagtctgtaagccgtgccactgccgcctccatttcagggcagggaacgaggggcacggtgcggatacagggatattcgaacacatcagcgcccaggtttcggagacgtgcggccagagtcccggcgcgctcccgggggcgcgtcacaacgatccggcgccctttgagcggcaggacgtcaaaccaatcgaaccgctccgcgagcgagcagaccggaccgataatgctgacagcgggactgactacgccattttcttccgccgcgcgaggcagcgtttccacagtggcgttcagacgcctctggtctggcaaagtgccccgttccacgatggcggcgggggtatcgggagccatcccggctgccagcaggccgttgcagatatcagccaggctttgcacgcccatcagaaatacaagggttcctctggtgcggacaagcgcctcaaaatcgatctcgagcggtttgccggcgcgggcgtgcccggtgatgatgtgaagcgaagaagtaaagtcccggtgcgttacaggaataccgccgtaggccggcgccgcgatggcggaggtgacgccgggcacctcctcaaaggcaacatcatgcgcggccagcagctccagctcctcgccgccgcggccaaacagaaaaggatcgccgcccttaaggcgcaccacctgtttgccctccagcgccttctccaacaaaatttgattgatttgttcctgaggcacgggatgatgatttgcctgtttgcccacattgatccgttcggcccgctccggaatcaatgccagaacgcaggggcttatcagacggtcgaacaccaccacatcggctgcctccagcgcctcccggcctttgatggtcagcaggccggggtcgccgggcccggagccgacaagcgtcacttttccagccatggtttatgcatcctccgtccgtttttgtaagattcgttctgcaagctcgattcccagggcttcgccctggctgcgcggcccaagaatcgtatcgaacaccggcgcgcctttggccgttacgtccatgccgcgcagggtgagcgtctcaccctgcacagtggcataggccgctgttggcgaggtgcatccgccgtcgagccgccgcacgaacgcacgttccgccaaagcgcagtcggcgctgtcccgatcaaagaaggccgacagataagaggcgttttctccggcgcgcgcctgcaccgccaatatgccttgtccggcggcggggagcatctcatctgtggaaaaatagcgggtaatgcgatcttcaagccccagacggacaagtcccgccgcggcgagaacaagcgcggcatactgtccgtcatccagtttttgaaggcgcgtctggacattgccgcgcacaggggcgaccggctgaccgggaaaaagttttttgagctgaacggccctgcgggcgcttgcacagccgatgggcttggccggatccagttcataaacgccattcggcaggacaagcgcatcccgcggatcggcccgttttgaaaaaccagccaacggaaggcgtgggtcgagatccataggcaaatccttacagctatgaaccgtgaagtcaaccattccatttaataaagcggcgtcaagctccctgacaaacaacccttttccaccgatcttgtccagggtgcggtccagaattttatcgccggtcgttttcatcgcaacaagctccagctcaatttcagggtcccattcccggacagcgtccatggccagttttgcctgaatgacggcaagcctgctttcccggctgccaaccttcaaatgcttcaatccaatccctccaatgccgtccggattgccttggccgcctctgcggcccgctgatgatcggtcccctcctgtgaaatgacgccggccaccgctccgccgccttcgcagactgccggaaagaaaaaggtgcattcctccctgcggtctgccacagcgacggggattccaagcgccctggcgtcacagcccacccgatggttcacatcacggcgatcggtagcggctatagcgagatatgcgccgtcgagatcgccgggggcgtatgggcgccggagccactggatatttccggcactgccgctccagacaggagaaaccactgtgaccgccgccccgaagcgcgcaagaacatccgcccgccgggcagcgacgggtccgccgccgacgaccacgcaccgtttgccggtcagatcaacaaacagcgggaaatgaggcgtgttctgtgtcattggcgttctccttcccccggctcctgactgaggtatgggtgttgatttttttaacgcatcgttccagctcctggggattaatcaattcctttagtcctccggtgatcagctcgaccgcccggcccacggcaagctccaccagctcgtcgcgctctatctcatccccgatctccggatatgtgagcagacgctgcgtgatggcttccttcaaggcttcgatcgctggcaggcatctgcgatagttgttccaatcatagaagcggctcatataatcatccaggatattaagcgcctcctgtggaatttgtccccggtgttgttttgcaccaagagtatccacattgtaaagcttgataccggggagagcgccgacgcatgggtccacatcacggggcattgccaagtcgaccacataggcaggttttgaagacagcatactgaactgctctgctgtaacagtataatgagggctaacagtggcagacaaaagaatatctgccttttccatggcggaaaaacggtcgtcatagggtgtggcggtacagcccgctggaatgaccgtcattccatgacgataggtgcgcagcgtcacaatgacccgacaaccctccgcatgaagcaaagtggccgccagccgtcccatttcaccatttccaatgaccagcgcgctgcgcccatgcagactgccgagatcgcgcttgaggacctggacagcctgcccggcggcggaaacagcgacatcggtgagatgtatctgcgtcttgattgcctttccggccgctacagcattgcgaaacagcgtttccagaacagggtccgccgcaccagctttacgggcaatggcaatggctgacttgacttgggaaagaatctgatcctcaccccaaatctgcgatttcaggccgccggccacctccatcagatggcggacggcgtctctgtcccgtctggtcacgaacgctccggcaaatgaggcgtggctcagttttacggcgtgacataaaatctgatcgggacacagtgtgctgtccgaagcgcaggagagataaagctccgtgcggttgcaggtagagacaagaacacagccgagcacccccttgacatcgcggcggatccgctctgtcagcgcctccacctgggcctttgtgaaggagagctgctcgcgcaacccgataggcgccagattgtaatccaatccggacataatgatctgcatgtgatcggaacacttcctttgcgccgggctttctttaaaagctcggctaaaaactttataacttttataaaaaagagaaattgacgaattttttgcaaacagcaggagaatgcaagacaaaaaacgcggtaaagaaaattttatccggctgcgccgcagacagcggtgcagccggcagaaaaaaggtttatgtgacagacggcttgttgaccacgccgatcaaaagagggatttcacgatcgatagatgaatcgcttgtaatggcgaataaaaagggacgatcaaaggtaagctcagttgttttgccggctttccgtatatttgttttcacctcagtattggaacttgttcctattccatactctccgatgctgatagcagcctgctggcgtacatcggtgagcgtcgttttgccgccggaaaccatagcggaaaaatcagcttgttcagaaaatggcgtgagtattcccatggatttaagcgcattgttgaaggtgagatcagcggaaaaagaaaatttaggaagcgacaatgcaacttgttgattttcgccgcccggtgcgaacaaagcggtcgttgtttcaggtgagttcaaaagctgattgacgccaacgccttcgtccgggagaatgagcagcatgctgccgccgctttttagcggaacacgcagacgtgtaaaattgccttccgccctgtaaacctccgcggaagcaagcgtacccttcataaagctgccgatggccgtattgccattggcaagggcaaagggaccagcctccgtattggcggggtcaaaggcatagagccattcgtcttcaaaataagggacattgatgatggaaagctgctgtgaagctgcgattttgaccggagggatgacgttgccgctggagtttttgacgatccattcggaaatctgccgtgcaaccgagagacgggcaaaatccacattcattgtctctgtataaaattgagaagctgcggtatcgttgaagtcactgcggaagattgcgttatcatgcagccagaaggagcttgcgagccggaaaacgccgataccgttatttgtataaagccggcggaacaaatttccgttttgcttggaaagataggaaatggttttatttttcatcccgagcacttccaaaagctcctggcgcgtatcaccacgcgcgccggtcgccgcaagagaaagcgacatgtacagggcggtcggactgtagattgtgttgcctgcctgaccatatagaatttccggggaacaggcataggaaaatgtgttgattgcatcgagcaaatcggtttcaagagggttttcctcaatcaatgttttttgtgccttctcatccccgtaaaccggtgcatccggataggttggcgcagccgccgtgcccgggatacatagtccagcgcaaataaacacagccattgaaaatgcgatcgcctttttcataattacttcctccccaatagagggcttgcccagccctattgagcctgtcaaattcctgataagcggtcatcaaacaggtcttgtagaaacagtggcaaaaaaagcgggaattatttcatagaaaccgatttttcatcaaaattggagaaaaaaacgccggtctttggaccgacgttttcttaaggacaaatttcgtaaaaatcgatcagacatcgtgcattttcagatatacaagataggcagctccacctgcacacgcgaggacaaccgctgcggctaacacaccgaacaatgggaaggagcggcgctggttggaggcgggctgtgtaacctgtggaaccgtcggctcggtcacatcgatctgtccggtctgtgctgtttcgcgctcaggctcggaagattccgcaggttcgctcccggcaggctccgaggaaatcccatctgagccgctggtcgtgggcggcggcaggattgtctgtgtgaccggcggcgtgctgttgccgccgccggttgaaggattcactttaatctgctcctcataggagtcggtggcgttatcgtcgagatcgatgtcgtaatcttgctccaaatccaactccgtgtctgaaacaatatatgtacccagggtgcgagttctggtggtccatccaggaatttcccgctcgctgcggctataagagaaactacttgtgacatcggtcagattgccgcgcgaatcgacctcatagatataacagtcattgggatagggggtgtaatcatcagcctcatcccatgggatgccaagcgtcagatatgcacgggaagaggagggaacctcgggatggccgacaaagtcgtaaaaccagaggtttgcatccaccggatcaccatactcgctgtagatatcgacatcggcctttgtggacaggcgcgcatagaagctgtcggcgtcgtcagaagcataaaattcaagcgccgcgcggtcatcaccccatacataaacgttccagtcgttatcgtcgggatcaaggtagacgttatcgcctgtattaatgttgtgatcggaaccggaagttttggtgttggcgatccacatagtgatatcaagcgtcgcacaatcgccggaatgccagtcaccctcgtcgccgtcagcggttttcagggtgttgcgcgccttaaaggtgacagttgcagtcgcttttttttcatcggttgaggtcgaatctttgagtacaaccttgagatagctgccgcgtgtggacgaaccgcctaaccgtttttcgttgacctgtgtgatggaacggatcagagatttgccgtcgccctccttgtcaattgaaattcggaacagactgtcgtcagccagttggcttgcagttgccatgcagccgtcgtcgaggatggttgtcgggttgaatctgtcgtctccaagctggatatagaaggtgcggtttggacgcacaccgtcaagcgtaatacgcccgtcgcctgcaatagaatcgatatcgaaggcgtcgccgtccttatcctcgagcgtgtcgccgtcatcgtcaaacacgccggtcggcatggcgacgctgcccttgtcaccgttcggcgcataggccccaagcgaggctgtgactgtcaaagccgtcgcgtcgcttttgacggcggcggcaaatgtcagcgcgcgtccgggacttggcagagcgggcatattctcgttgaccccggttacattgaaagcggtgatctgataaccgcttttcggagttaactcaaattgcagccggtcgcctgtctgaacggtgccggttccggccgcgacaaccttgttctgcgtcaggttgcgtatagtcagcgttccctgctcggtaacaagcgtgggaagcgtgacggtgacatcacgcttcgcagccgtctggaaggtggctgcaacgcttgtgaccgcttccttgacggtataggggaccgtgattgtatcgccggtatgggcggccgcacgggccggactgttgagatcatagatgatttcgccgttgacagtaagcgttacaagctccttgccatcattggggacgatccggaattcgagctgcgctccaacaggcagggtcgtatctgccgtcaatggctgaccattgtaataaattgtaagcttgccatccgctggctgtgtgtcggggatctcaaccggtacgctgtccgcggtcttgaaagctgctgcaaagagaatatcacccttgagcgtatagggcgcgccgcttgcaatcggcgtgccgccggccgtcaatgtatcgagaacataaccgtcgctgggcgtcgctgtaacgaccagctccgtgccccagtcgagctttgtaccgctcgcgacgggctggccgccgtttgtgacggacagtgttccgttaacgggcgcgtcataagtgacggaatgctggagcgccttaaaggacgccgcgaccgtcgtatcctgcttgagcgtaaaagtcgcgccgcttgcgaccggcgtgccgccggccgtcagcgtattgagtgcatggccctcgtcaggcgtcgccgcgacagtcagcactgtgccccaatcaagctttgtaccgctcgcgacgggctggccgctgttcgtgacggacagcgtaccaccggtgggagcagtatatgtaacagaatactgcatcggttcaaagacggcggcaatggttttgtccatgtccgcagactggaaagatactgtatacggcggtgtcaatgcgatgccctttgcggcaaggcttaaaagccgctggccctcgccgggaacagcttcgattttgattgcggtatttgcggggacagccgcctggccattgacaaccggataaaatttagacgagtcatccctctcgctcagtttgatttcaccgctgcctgtaactgaaacggtgacaacgacgccggtgtcgagaaccggatcggctgcaccctccgcgagcaccaccgccgagatgcagcccgccagcaaaatacaggcaagtatcaatgaaaggacacgcttcatggttggtcctccttttctttggtcagccgaagggcagacacatccttattatattcagtattattttaccggagaaatatgtacgaatcatgtcgagaatgtgtctgaaatatgaatagggcgtcggaattccgacgccccgctgttcgtttgattattccgggtcattgacaatccactggctgatatgcttgataaaagtagaatcctcagtgacaaccttgacaggcttcgtataatcgagcgccatcaggcccaaaatcgatttggcatccgcgattttaccatctgctgtgtgcacgccgatatcttcggacgactgcatagcctgatacataaactggcgaagatcttcggccgaatggagcatgacgtttttgataatcataatgatgacctccttatgaagtgtctgtttagtttcctctttttacatctttattaaactacattttccgaagaatgtcaatatgtataataaaattttttgtgattgtacaaaatgacagatattagcagtctctgtatttgagtgacaaaaaactgtaaacatttcgtgaattcacttgacatctctggaaaatgtggtacattagtgttgttagcaatcaaaaaggatgagtgctaaagcaagcggggtgagatcgttgaagctcgatatcaggaaattaaaaatcctgacggccattgttgagacatatattgaaactggtgagcctgtcagctcgaagatgctgactgaaaaactcggactgcaggtttcctcagccacgatccgcaacgatatggcggcactctttgaaatgggcctgctcgaacagccgcacacgtccgcggggcgcgtgccgtcgcatctgggataccgcatttatgttgaccagctcatgcgatgcgaacctctttcagatgaagaacgccgcgagattgacgctctgtttaatgtgcgcgaccccgatcccgacaaattgcttgaggacgcggccgaggcgctggctgattatacgaactgcgcgaccgtatccactacgatcacgccgcgcacggtccaggtcaagcgcattgaaatcgtacctgcgggcgcgcggactgtggttgtgctcgttatcgcgacaaacggcgtgatcaaaaataaagtctgccgcgtcgacttcaggctgacgaacgaactggtcggttttttaaaccagtttgccaacggccgcctcgtcggtaagccggtcagtgagatttcgcagtattatgtcaactcgatcgccgtcacgctcggagaatattccgcaccgtttgttccggtgctcgccacgatttacgagctttgccgcgagatcagcgaagggcagttttatacgtcggggggcgcgaacctgcttggctacaaggagtttggcgacattgcgcgcgaactgcttttgacgatgaacagccgcagcgatctgcttggagtgctcgcctcgcgcgacgacgcggtattcatcagcatcggcaaggagaactcaaaaagcgagttggctgacacctcggttgtggtgacgcactacaagatcggggaacagaactcgggagcgatcggtgtgatcgggccggtgcgtatggattacgctaagattattccgcaccttgaatatttttcacagacgctcggaaagcttttggcggaaacctttgaacaggaatagatattacaataacacaaacagataggtagtgatcagaatgcccgataccaccatgaacgatcagatggagcaggagcctgtggagcaggagccgcaggcgcaggacgtgcctgaagaaactcccgcgcaggagcagaccgcgcaggaggagcaggatggcgaggcgaagcttcaggcgcaggtggccgatctgaacgaccgcctgttgcgcaccatggcggagtacgacaatttccgaaagcgcagccagcgagaaaaggaatctatttatccgcaggcgacggccgctgccatcgcgcagttcgtgccggttgccgacacgatcgagcgggcgctcgcggcgccgtgcgccgacgaggagtataaaaagggcgttgaaatgattttgcagaatttcaacgacattcttgccaagatgggcgtcgaggcgttcggtgctccaggcgatacattcgatccgcaggtgcacaacgctgtgatgcatattgaggatgaggcggccggggcaggttcgatcgtcgaggtgttccaaaagggataccgcctgggcgagcggatcatccggcacgcgatggtgaaggtagccaattagtttgggcggctgttttgccgccaatataaattctgttacattttatttttcaatattttggagggcttacattatgggaaaaattattggtattgaccttggtacaacaaatagctgcgtggcggttatggaggctggcgagcctgttgtaattgcgaacgcggaagggtcccgcacaacaccgtctgtcgtcgcgttttcaaagacgggcgaacgcatggtcggccaggtggccaaacgtcaggcaattacgaacccggaccgcacgatcgcttcgatcaagcgccacatgggttccagtcataaggtgacgatcgacgacaagagctatacgccgcaggaaatctcggcgatgatcctgcaaaagctgcgcagcgacgcggaggcatatctcggcgagaaggtcacggaggcggtcatcaccgtaccggcgtacttctcagatgcgcagcgccaggcgacaaaggacgccggacgcatcgcgggacttgatgtcaagcgtatcatcaacgagccgacagcggccgcgctggcctacggcatcgacaaggaaaccgatcagaaggtcatggtttacgacctgggcggcggtacgttcgacgtttcaatcattgaaatgggcgacggcgtgcaggatgtccttgcgacaaacggcgatacgcatcttggcggcgacgactttgacgagcgcatcatcaattatctcgcggataccttcaaaagcgagagcggcatcgacctgcgcggcgacaagatggcgatgcagcgtctgaaggaggcggctgaaaaggcgaagatcgagctttccggcatgacgacggccaatatcaacctgccgttcatcaccgccgacgcgaccggcccgaagcatcttgacgtgacgctgacgcgcgccaaattcaacgagatgacggccgaccttgtcgagcgcacgatggagccggtgcgcaaggcgatggccgattcagggctgaaggtttccgatatcgacaaggtgctgctggtcggcggctccacgcgtattccggccgttcaggaagctgtcaaggcattctgcggcaaggatccgttcaagggcatcaacccggatgagtgcgtggcggtcggcgcggctattcagggcggcgtgctcggcggcgacgtcaaggggctgcttctgctcgacgttaccccgctttcgctcggccttgagacgctcggcggtgtctgcacgaagattatcgaacgcaatacgacgattccgacgaaaaagagtcagatcttttcgacagccgccgacgggcagacctcggttgagatccatgtgctccagggcgagcgtgagatggcgcgcgacaacaagacgctcggcatgttccgccttgacggcattccggcggccccgcgcggcgtcccgcagatcgaagtcacctttgatatcgacgccaacggtattgttcacgtgacagccaaggacctcggcaccggcaaggagcaaaatgttacgatcactgcttcgacgaatatgtccaaggaggacatcgaccgcgccgtcaaggatgcggaggcgttcgcagaggaggacaaaaagcgccgcgaggagatcgatgtgcgcaacggcgccgatcagatggtctatcagtgcgaaaaaacgctgacggatctgggcgacaaggtttcgtccgatgagaaggcggctgtccagaccaagattgacgcgctcaaggaggcgctcaaggggacggatatcgcggccatcaaggaaaagcaggaggcgctccagaaggacttttacgatatgtccgccaaaatgtaccagcaagcgcagcagtctgcgccggacggccaggccgccccgcaggacaacggcagcgccggcggcgacgggtatgtcgacgctgatttccgcgaggttgacgaggacgacaaaaagtaataaaataggcgaggtatgcaggcgggcgcgtacacgcccgcctttgcttagagccgtttgaaaatgaacccaaccgttcgtttgcaggcggctcccagtgtcaacagaggtgaggaaattggctgataagcgggattattatgaagtgcttggcgtcgcgaaggatgcctccgcggacgatttgaaaaaagcataccgcaagctggcgaaaaagtaccaccccgatctgaatcccggcgacaagacggccgaggcgaaattcaaggaggtcaacgaggcatacgaggttctcagcgactccacgaagcgtcagcggtacgatcagttcggccacgcgggcgtggacccgtcctatggcgcgggcgcaggcggcgcgggaggctttggcggcggtttcggcggctttgatgtcggggatattttcgaaagcttttttggcggcggtttcggcggatttggcggcagcacacgtacacgcaatcccaacgcgccgatccgcggcaatgatgttaatgttacaatcgggctggccttcatggaggcggccaaaggctgtaagcgccaaatacaggtgcagcgcttggaaaaatgcgagacatgcggcggcagcggctccaaaagcggcaccgcgcctgaagcgtgccccgactgcggcggcacaggccaagtcaaggtacagcagcgcacgccgatcggcgtgatccagacttcgcgcacctgcccgaaatgctccggaaagggcaagatcatcaaggagccgtgcgctgactgtcacggtatgggccgcgtgcgcaaaacacgcacgctggaggtttctgtcccggccggcatcgacgacgggcagacgtttgtactgcgtggccaaggtgatcagggcgtcaacggcggacctgccggtgatgtgaatatcatggttacgctgcgccctgacacgctgttcgaacgcgacggctttgatgtgtggtgcgatatcccgattacattctcgcaggctgtgcttggcgacgagatcgtcgtgcccacgattgacggcaaggtgaagtatacggtacccgagggcacgcagtccgggacggtgttccgcctgcgcaacaagggtatcccatatgtcaatggccgcggccgcggcgaccagtatgtaaaggtcaatatcgaggtcccgcgcaatctgaatgcgaagcagaaggatgcgcttaaaaagtttgaggaactttcgagcgaaaaaaattatgaaaagcggaaaagcttttttgaaaagctgcgggatgcaatgaaataaaaatggaacatttttcaaattaaattgtttacaaaaccgccctttgaaacagggcggttttgttgtatactataaaatacggtatgttcggccgtggacagagaacagggaggacattttatgcagtatagtgaaatccgaattcgggtgcgcacgcaggatgtggatacagccggcgcgattgccgggttggttgtcccatatggcttttatattgaggactacagcgatattgaggagttggccccgcagattgcgcatatcgatctgatcgaacaggagctgttggaacgcgaccgcacgcacgcagtcatccatttgtatatttcccctgatgaaaatccggcggaggccgtgtcatttctgcgcgaacgcttcgatgcagccgggatttcctacacagtccaaacagatcttgttgatgaggaggactgggcgacagcctggaaaaaatattacttcccgacaaaaatcggcgagcggcttgtgatctgcccgtcgtgggaaagctacgctcccgcgccgggagaaactgttctgaccatggatcccggcatggcttttggaacaggcacgcatgagacaacgcgtttgtgcatacagcttcttgaggaggctgttacgcccggtatggatctgctcgacattggaacaggcagcggcatcctggcgatcgccgcgctactgttcggcgcgcgggcggccgtcggcgtcgatatcgacgaggtggcggtgcgcgtcgcacgcgaaaatgcaaaggcaaacggcgtcgggggcagggcacgctttattgcgggtgatctggccgcgaaggtcgacggtgtctttccggttgtgacggccaatattgtcgccgatgtgatcatccgtctgattcccgaccttgggcgttttctgacagaagggggcgcgtttatcgcctcaggaatcatcgacgcgcgcgagcgggatgtaacatcggcattggaagcggctggatatcgtgttgaaaagcggtgtgagtccggcggatgggttgcgcttttggcgcgccaggcttgaggaggatgagcatatgccgcgctttttttgtgggcaggtctgcggcgatacagcggtcgtaaccggtgaggacgcgcgccatatggcgctttcgcttcgtatgaaaatcggcgaggcagtgacggtgtgcgacggcgcgggacgtgactatcaatgccggatcgaaacgattgccccggagcaggtgcttttgcgtgtcggacagtccgctgtgtcggccggggaaccgcgtgtggaaatcacattgtatcaggcgatgccaaagggcgataaatttgaatcgattgtacaaaaggccgttgagcttggcgccgcgcgcattgtgccggtgctgacgcaccggtgcgtgtcgcgtccggacgaaaaggcgatgcgcaaaaagctggaacgctataaccgcatcgcgctggaggctgccaagcagtgcggccgcggtcggatcccacaggtggagccgatgctccatttttcccaggcggtcgaacgtatgaaatgcgaacctttggcaatccttttttatgagaacgcagaccagccgttgcatcaagcgctcagatccggcgttggcggccgaatttctctaatggtgggcagcgaaggcggtttcgagccgtcggaggcggggttcgcggttgaaaacgggctgatggctctgtcgctcggcagccgcatcctgcgttgtgagacggcgccggttgcggcgctcgcagcgattctgtatgctgcgggggagttttgatcatatatgtcccaatcggatatatggaaggatgtgacattgtatgagtcgaaggagaaagcgttcgggcggcagtcgtcttgcggcggttcttacaacgctttgtatgttttttttgatgggcatggttccttttgtattgatcgccgcggcacggcagcctggggaaaagcaggaggaggccgctgtgcaaattgaagaaaagatatccaagccggaatcggtaccggagcagacgcatgtttcggatatacgcgaaggggaggagatcaccgcggaggggaaagacaatttgctgattcttgtaaacgcacagtatcccatgtctgaggattatgcgccgcttgagcttgaaaaggtgcagggcgattatcagatggatacgcgcgccgccgggccgatgcgtcaaatgattgcggatgcgcgtgcgcagggtgtggaactgctgctttgttcagcgtatcggacgcgcgcgcggcaggaggtcaattttcaaaacagcgtagacacttatatggcgatgggttacagcgaggatcaggctgttatggcgacggccaggctgattgcagtgccgggcacaagcgagcatgagacggggcttgcggctgatatagtaacgccgtcctatcagcgtctggatgcgggatatgccggtacaaaggccgcaaagtggcttttggaaaatgcggcgtcatacggctttgttctgcgctatccagaggacaaaacggaaatcaccggcattgattatgagccgtggcactatcgctatgtcggcgtggaggcggcgaaggagatcatggcgcagggactctgcctagaggaatacgcagcgttgagggagcatcagaatgcttgataagcaaaaacttgcatataaaacggcgcggctgctcggcggcggcatcggtcaaaagcgggccgccgctgcgctctgtgcgctcctggctgtggtcgccgccggcattttgctggcttggcgcgcagcggggctgcgcagggagctgatgaacagccagctcgtgcgattagcctccgtacagccggacggctcgctcgcacgcctgctgaccgatccggagcgatcggccctgtttatgaaatatatcgattcatttgccgatgcggccgggaatctggaaataccgatgcgaaagcagctaatcaggttttccacactgtcacaagctgcacaggacacaggcgttacgctggagacattttcttacgactgggcgcaaaagaccttgtccatcgggtgtacaggcgaatggcaaagcgccgaagcgtttgcagtgcatctgactgaaagcggtgatttcctgtctgcaaaggcatatcgttcagatgattataaatattatatagttttttgtgaatttgattaaaaaaattattgatttatacgaaaaatttgcatgtttacataattatcacaaccccaacagattttttaaaaaggttgtgataaaatgaaaacgaaagcatggatgtgaacatggaacaacctacaaacactggcgggctgcacctgtcaaaaaaagatacgcatttgctgattggcacgatcactctgtttgcactgcttgtgcggttgatgatcgcttatacgtccgtacactattatgacctgagcttttatgtcgattggtcgacgggtgtggcgcgcgatttttacggcgcttataataatattgagtcgctcgattatccgccgctgtttttgttccctttgtttttaacaggaaagctgctttcagtggatgtatttgcaatcttcgaaccgtacaggatgctggctcttaaaggttggcagctcttgtttgataccgcttgtgtgccgcttttttatactgttcttcgccggtggggtgttttggcttcaatcgcaggcgcctcggtttgggcggtgaacccgactgcgctgcttaacagcgcatattggggtcagacagacgcgattatgatttttttggtagtcgctgcttttgcgcttctggagcgcaggcgggccgtatggtccggcattgtgatgacgctcgcatgcctgatgaagttccagtcgctttatttcgcgccggtttacgccctggtgttactcactgcttacccgccgcgcaagtgcctgcaaaccattgccgccggtttgggaacagccgcggctgtatttcttccgtttatggcacggtccgggttcgcgcttccctttcgaatttattttggcggatttgaaaagtatgcgggtacttcgctcaatgcgttcaatttatacggcgcgcttggcttgaattaccaaagcatcgatacagagctgatcggcggcataaccgcccaaacagtttccatgatcgccagtattctggcaggcgtgctgctggtttacctcttttttacagctacgactcgcagcctttggctgtttggatttgtgttcatgcagacaatttttctgttttcggcgcggatgcatgaacgttatcagattcccgcacttgcgatggctcttgccgcgtgcttttgtcacaaaagccgaaagctttttattggattcgcagctttgacagttataacctttttgaatcacttttttgttattgaggaaatgttcaccgcggataaaagccttgcatggatcgcacattacgatctcatcgtaattgtcctgtcttgggtgaatctgctgctttatgcatggacgctcgcaatatctattcaaattttctataagcatggcaaaaaaccttttttacagacgttgcgtgccggactgccatattttggcgggcggccgttaccgggacaaggatcgccttgattggccttgaatataatgaaagcggtgtttccaatgaacttattttcgcacatcacaatgggcaggtatctctacacttatttcaccgagcagctcggtgtggagcttgacaaggcaagcttcgtaagttggaatgtcctgcccgacgtcgcgccgagcctgttgaagctttcccacttcaaaaaggatatttatgaccttgtgatggagcgtgcggaacgcctggcccgggaaggggacaccatgacgcttgccgaatacagcaagcagttgggcatcctgtgccacttcatgtcagactttttctgctatgcgcattctgaaaacttcgacggaagtaaaatcggccatttgaaatatgaaatctgtatgcagttctatggctacagacgccgtagtatgctgcatgcagttgacttgatctcaaatgcggcggaggtggaccgcagcgctgctttgtatgagcagatcaatgagctgcatgaccggtatatggagatgacgccttcatacggcgttgactttgtattttctctgacagcatgtgtggatctgctgatgggtgtgacgcgccggcaggccgcagccgcagcggcgtaaaacaaacgaacatattgaaaaaggagggaaaggccaattggcctttccctcctttttcaatatggatttgaagtttcctgtcacatttgctcgttttacaagcagaacgcattgaacagaaagagggtggttccatggatctgtacattgtagtcagccagacaggcacgtatttttcgcgccttttgcgtgccgtaaaccgggagccgtataaccatgtctcaatcggtctggaaccggagctgaaacgcctgtacagctttggccgtcaatgcctttttttcccgcttgcagcaggttttgtcagggaagaaccgggacacggcgtttattgccagtattcagatacacgatgcgtggtttatcggctgtctgtgaagcggcgtgcctatgaacaggcacagcgtttgatccgtcagtttgaacagaatgaatggcgatatcgttataactttgcaggactgcttgcgatgcttgtcaatatacccattgaacgggaccgccatttcgtatgttcgcagttcgtggcgtatgtgcttgagcaaagcggggcatacagctttgatcgggatttttcattggtgcggccacgggattttatgcgtttgaagggcgcgcggctgatctatgaagggcgtctcaacgactatgcgtatccggtacaggcgcgtctgctgccgtatgcgctgtaaatatagagccgaacccgcatcctttggagaggggatgcaggttcgggaaagcctggattgaaaaggaaagcgccgcccatcgggcggcgctttccttttcaatggctttacaacactttattgagaaaatcgattgtgcgtttttcacatgggttggcgaaaatatcggccgggtcgccttgctccacaatcacgccttcgtccataaagatcacgcggtcggcgacctcccgggcaaaccccatctcatgcgtgacaacgaccatagtcataccgccatcggctagctgccgcataactgcgagcacctcgccgaccatctcaggatcgagcgcagaggttggttcatcgaacagcataatatccggatccatagcgagcgcgcgggcaatggccacgcgctgttgctggccgccggaaagctgtgccggataaacagaagccttgtccgccaggccgacacgttcgagcagcgcgcgcgctttctgttcagcggccgccttatcgagttttttgcggtcgagcggagccatggtgatgttgtcgagaacattcagatgcgggaacagattgaactgctggaacaccatgccgatattttcacggattttgtttaagtcggcttttccgtcggtcaggatatggccgtctacctctacctcgccggatgtgggcgtctcaaggaagttcagacaacgcagaaaggtgcttttcccggaaccggacggaccaatcaggcaaacgacctctccttcgcgcacctccaggtcgatgccgcgcagaacctcaagtctgccaaagcttttatgcagattgttaacccttacctttgccatttgacagcctcctttcgatcattctggacaacctggacaacaggaaaataattacaaaatacatcgctgctacggtggcccagatttcgaacgaacggaaattgcgcgcgatgatcaaactgccggcctgtgtcagttcaggcataccaattgcataaagaatcgaggtgtccttgagtgtgatgatgaactgattaaccatcgaaggaatgacaatccgcaccgcttggggaaggatgaccttgcgcatcgcgcggccatagggcagccccaggctgcgggcggcctccatctgaccgatattgacagcctgaatgccgctgcggaagatctcggacagatatgcgccggcattgagcgaaagagtcaggatgcctgcgatctccgcgctcatgcggacatcaagcgcgcgcgtcacaccgaaatagataaaaaatgcgagcaccatgaccggaacgccgcgcatgatatcaatatacgcctgcgaaataaatttcagcacacggctgtgtgaaatctgaaacaggcaggagatcaatcccaggacggtggcaaagatcagcgaaataacggttactttgaccgtaccttgcagcaaacctgtcagtagttgtggaaatgattgtgatagtagctcaaaatagctcaaagcaaccgtcctttcttgtaacaaatcccaaaggtgcgggaaacatgcggcaaagcgccgcaataaaccggaatacgcagcgggatgaaacgcaccccgctgcgtaaaatatttgtgaagctgttattcctggatataggtatcgaggatttcctgatatttgccgttctccttaagattggcaaggcccttgttaaacatgtcgagcagctcggcgttttggcctttattaaccgcgaagccgtaggacgagccttgttccttctccgtgacaatcttcagaccgatgtcctgtgaaacagcataaccgagaaccgggtaatcctcaaagcaggctgcggagttgccggagatcacatcctcgtacatattggacgaatccttgaaatacgtggtggtaaagccatattccgccttgatggactcagcgaaggcggaaccctctgtgccggtcttgacggcgacgttcttgccgcgcaagtcctcgtagcttttgatttcttcattgccggccttgatccccatgacgacgccggaatcaaaatacggctcggaaaaatcaaatgtgtcctgacgttccggcgtgatgctcataccggcgatcacggcgtcggactggcctgcctggagcgactgaacggccgcgtcgaagccgagcacctgaatttcataggaaaagccctgatcttcggcgatggctttgagcagatccatgtcgatgccgacaaattcaccgctttcattctggaactcgaagggagcgaaggttgtgtcggtcgcgatcagataggtcttgcctgcatccgtaccagcggcggacgcatcgccggaagcgccggaagaagcggtttgctttggggcggagctgccgcaggcggcgagcgaagcggccgcagcgcaggccagcgtcagggcaagaagcttttttatagatttcattgtgtttacctcctgtgatcaataaataatggtttcagcctgattgcaggatatataaaaatatcctgcataaagtaggccaaaagctgggcggcatgttggaggccgcgatatgcctaatagtattattctatagtaagtatatagatatgtcaatccctgttgaaaagccggagcggagaaaatggaaaacctgaaggaaatctttgtacttcaggtgcagcctgtttgttttcattattcaaacaggccctggccgagcgatacaggagaaacgccccgcgcagcggagaacactggtcaggacgggctgtgaaagtgtggcgggcagaccggtactgtcaatctgtgggaaaacgatgtgctctgccataacagccccaatatccgcatcttgcacagcgttaaacggaataagctccagcgagcgcagctcctcaagtgttttgttgacggaagacaggccatggcgtgaatcaatggaggaatatgcggcttggtgcatgacaaaaaggatgaccaaagtgtatcacaaaaagggatacttgccaatgccggctttgattgaacgacgactgtttttgccagacggaaaaaagtaaaatcaagggaaaaatacttgtataacatgcccgtgtcaatgttgaaacgtataaaaataacgttaaatttttatctattaggtcaaaatattgaaaaaatacaaaaaatttatgaataatcctaaaacgaaacgtttttgtcggatgatgattggcgaaaaagtctatggattttacaggatttttgcaatatactttttaacacatgaatgtgctactttaaagcaatgggagattgttttgtacctcccgagctgaatttaggaggaacataaaatgaaaaagctcttggcagtaacgttggcggccgccctggccgcaggttttgccggctgcggcggttctgggaattcaagcggaacgacaggcaacgccgcttcaaccgcttccggttccgcagacgctggcgaaaccatcaaggttggctctctcgcgccgctgaccggttccgtatcggtatatggcatttcaaccaccaacggcattaaaatggcagtcgacgagatcaacgccaacggcggcgttatgggccgccagattgaacttttgaccgaggatgaaaagggcgaggttcaggacgctgtcaacggctacaacaagctgatcagcgacggaatggtatttttgatcggcgacgttacttcgaagccgtgcgacgctgtagcgaaaatcgcggccggcgacggtacgccgatgctcaccccgaccggtacagccccttcgattacccagaatggggacaatattttccgtacctgcttcctggacccgttccagggccagattatggcgcagtttgcggctgaaaagctcggcgcgaaaaaggtcgccgtcatggcgaactcctccgacgactactccgacggtattgccaaggcatttgttgccaaggcgcaggagctggggcttgaggttgtcggcgacgagcgttacggtgcggacgataccgattttaaaacgcagttgaccaagatcaacgcagccggtcctgatgtgatcatgttcccggattattacgagaaggtggccctgatcacaaaccaggcccgtcagatcggctttacaggtccgatgctcggcggcgacggttgggatggcgttctgacttccctgggtgagaatgcttctgttgtggataattgctacttctcctgtcattacttcattggcgatacgaacgagcaggttgccagcttcgtcaacggttatcgttccctctacaacgaggacccgaccgcgttttccgcgctcggttatgattcggtctatatcatgaaggccgcgattgaaaaggccggcaccacggataaggccgctgttgtcgaagctctgcgcgctactgattacacgggtgtgacgggccatatgactttcgatgagaatggcgacccgatcaagagcgtcgcggtgctgcgccttgaaaacggcgagacagttctcgacacgatgatgacggctgacggcgctgaggattccacgcctgctgcttctgagtcagcgtcctccgaggccgccgcgtcctccgaagccgcatcttctgaggctgccgcatcttctgaggctgccgcgtcctccgaggccgcttcttctgctgccgcgtaaggcgtttataaaacgatgcaatcaggggcagggcgataggtcctgccccattgcggttttcatatgaatatgacaaaaagggcggttcgctttttaacagtgtggaaccgctgaatggctttccggcatatgccggatcagaaagaaaggtgagatgcgaaatggacggcctgtttgtttttatcaaccagttgatcaacggattacaggtaggcagcatctacgccctcgtcgctctcggctacacgatggtttacggcattgtgaagctgattaatttcgcgcatggcgattttattatggtgggggcttatctggcgctgttttcggtgccgatgctgcttggagcgggactgcccgcgattcttgtcattgtactggtcatcgtaatgtcggtcattggctgttcgcttctcggcatggcgaccgagcgcatcgcttataagccgctgcgcggttcgccgtcgctgtcggttctgattacagccatcgcggtcagcctgtttttggaaaacctgtttatgattctgttttcctccgcctccaagccgtttccggcgatcatcagcgccaatccgatcagcatcggtaaaatccagacaaacgccgttacgatcattacaatcgccttgtcgattgtctgtatgatttgcctgcaactgtttatcaagaaaacgcgtatgggcaaggcgatgcgcgccgtctccgaggacgctggcgcagcgatgctcatgggctgcaatagcaacgtgacaatttccatgacgtttgcaatcggttccggcctggcggctgtggcggctgttatgtattgttccgcctatccgctggtcaatccttacatgggttccatgcttggcctcaaggcttttatcgcggcggtgctcggcggcatcggcatcatcccgggcgcgatgctcggcggttttgtgatcggccttgtcgagagcctgacaaaggcgtatatatcctcgtatttggcggacgccgttgtgttcggtattttgattgtcgtgctgctcgtcaaaccaacgggcatcctgggcaaaaacgtcggtgagaaagtgtaggtgaatggcatggcttcaaaacgcggcaagacttatttttcctatctcgtcaaccttgtttgtgtcgtcctgttgttcatcgttttgaccgcattgatgaaggcgggcgtgatcaacacttattgggcgggcgtgatcatgctgattatgatcaacatcatcctagcgacctcgctcaacctgacaacgggcgttcttgggcagattgcgcttgggcatgccggctttatgtcggttggcgcttatgcggccgcgattttttccatgaagatcgccgaggcggcaaagcttgttgaaaaaggtgcgccgacggccgccggtttcggcacgtttctggcgtctcttgttgtagccggcgttgtcgccgccattttcggcctgatcgtcggtatcccggcgctgcgcctcaagggcgattatctggcgattatcacgctcggcttcggcgaaatcattcgcgtgataattgagaatgtcgaatttaccggcggcgcgcaggggctttccggcatcccgaagctctccaatttcaacacggtctactgggtgacagccctgaccattgccgtgctgtttgcatttggacgttcgcgccatggccgcgcgatcattgcaatccgtgaggacgatatcgcttcggaggcatcaggtatcccgaatacgtattacaaggtgctcgcatttacgatttcagcgttttttgccggtgtggcaggcgctgtctatgcgcagcagatgcaggtgctcggcgcgaaaaccttcaatttcatgcgttccatcgatattctggtcatcgttgtgctcggcggtcttggttcattgaccggttcgatcatcgcggctgtcggcctgactgtactgcctgaggcgctgcgcggtttctccgaatatcgtatgctgatctattccgtggcgctgatcgtcgtcatgatctttaaaccatccgggctgcttggcacgcgtgaattctccatgtcctcattgctgcgctggctgcgccatccgcagtttaaacgaaaaaaagaggcggctgaaagggggagcggcaaatgagcaatcctgttctgaaagctgaccatcttggcatctccttcggcggactcaaggcggtcgagggatttgatctggaaatccgtgaaaatgagcttgtcggcttaatcggtcctaacggcgcgggtaagacaactgtgttcaatatgctgacaggcgtttatcagccaaccgagggcgccgtttatctcgatgggaatctgatggcgggtaaaaaaccgcatcagatggtaaaagccggcatcgcgcgcaccttccagaatatccgcctgtttaagaagatgacagttattgacaacgtgcgcgtcgctttcaatctgcatatgaagtattccgtcctccagagtattctgcgtacgccgcttgtctggaaagaggaggaggagattgaccgcaaggcgcgcgagctgttgtccgtgtttaatatggaagggcttgccgatcatatcgcggccaacctcccgtatggccagcagcgcaagcttgaaattgcccgcgcgcttgcgaccaatccaaaggtgcttttgcttgacgaaccggccgcaggtatgaacccgaccgaaaccgcggagttgatggaggcgatctccattatccgtaaacggttccatgtatccatccttctgatcgagcatgatatgagccttgtcatgaagatctgcgagcgcctggtcgtaatagactacggtcagattattgccgccggcacgccgcaggaagtcgcgcgcgatccaaaggtgatcggcgcgtatctcgggaagtaggaggggagccaatgctgaaagtcaaagatctgaacgtgtcgtatggtgccatccatgcgatccatgatgtgagcttggaggtcaacgcgggcgaaattgtttcgctgatcggcgcgaacggcgcgggcaagacgacgacgcttcatacaattacgggactgaagaaggcgtcatcaggatccgtcgagctggaagggcacaaccttctgacaaccgagccatcaaagattgtcggtcttgggatggcgcatgtcccggaggggcgacgtattttcgcatcgatgacggttgaggaaaacttggagatgggcgcttttaccatcagggacaagtcacagattttagcagatatagaaaacgtctataagcattttccacgcctgcgggaacggtataagcaggctggcggcacgctgtccggcggcgagcagcagatgctcgcaattggacgcgcaatgatgtcgcgtccaaagattatgttgatggatgaaccgtcgatgggcttatctccgcttttggtgggcgagatatttgaaattattcaggaactgaaccgcagtggcatgaccattttgcttgttgaacagaacgccaaaatggcgctgtctatcgcagaccgcgcatatgtgctggagacagggcatgtcgttatgaacggccaggcaaaggatatgctggaggatgatcaggtgcggcgggcatatctcggcatgtaaaaaaacagataccgtccggctgtcaatgtgttgcagccggacggttttgccatggaggtaaataaatggcggaggtaaaaacgaatgcaatgcgcatgttggaccgcgcaaaaatcccataccgggttcacatgtacgatcatgcagacggcaaaattgacggcgtcagcgtcgcaaaaaagcttgggcaggatgtcgatgccgtttataaaacgcttgtcaccaagggcgcgggcggcggctattttgtgtttgtaattccagtcgcgcgggagcttgatttaaaaaaagctgcgagggtcgtcggggagaaatcggttgccatgatcccggttgcggatctcaataaagcgaccggctatattaggggcggctgttcgccggtaggaatgaaaaagctgtatccaacggtattcgacgcatccgtgctcaatctttcggctgtgattgttagcggcggccggattggctgccagattgaagcatcgccaagcgacctgctgcctcttgtcaaagctgtgacggcacagattacgtttgattaaaaaaatatagagcaaacgccccggcatttttgaccggggcgtttgtttattctccaatatacgtaaagcgggcgatacgttttccgtcgcgttcaatttcttccatgaacatatcgagcgggcgcacccacaggccgccttcgccatacaaggcccgatagacgacaagctgttcgagcgtttcgctgtggcgcgctaaaccaatcgcctcatattcattgcccttaaagtggcggtatcgcccgggacggaaggcgcgcggctggtccggtcgcgccgcgggcgcgtccggcgcctgagccggcgcagccgactcaggcgtccccggcgcggcatgcgccgcgccggccagccgcgcgccgtcctccggtggaacaaggatacgcgcgccaaaggcgggcagctccagcttgagatttctatcattcgtttcaaaggttgtaccggtgaacagatcggtaagcggcgcgttacgcacatggaattcaacatattccgggtggtcagaaagattaagcgcagtataaacatgctgcccattaaaagcgcgttcaaatacaaattgttcgtttttaacaagcctctgttcatacgttccgtactggagagcaggcaggctgcgccggatcattcccaaacgtgcgatatgggtgcaaagaggttcatccgcttcgacaatttgtccaagctccaggcaagggcgcagcggtgcgtcagaaccgccttgtttagcgcctgtaatgccccattcactgccatagtaaatagacggtacgccaggcatcgtatagagcagggtataggtgttataaagatgggtacggttgcgcagcatggttgcaagacggttgatatcgtggttatcgacaaaattataaagacacaaatttttatagatgccgccgtttccaaactgccggttcagggaataagcgatttcaaaatagtttttgtcattgtgcgaggaataaaggcccttctcacactcatagttggtgacggaatcaagcatatcgggattggcccatcgattgtagtcgccatggatgatctcgcccatcagccagaaatcagagcgtttctcacggcagtagctgcgcagccgtcggaaaaaggccggatccacacagtcagccgcatcaagccgcaggccgtcgattccaaattcgtccatccacatgccgaccgcgccaagcagatgatcaacgacctctggattttgcagattcagcttaacaagattaaagtgcccctgccagccctcataccagaaggggtcgcccatcgggctgccgccgccgaagttgagattatgaaaccatccgcaatatctggatgcctggccgtttttacgcacatcttcaaatgcccagaaggagcgtccgacatggttaaagacgccgtcaagtacaatgcggataccatgcgcatggagcgtttcacaaacttttttgaaatctgcgttggttccaagccgccggtcaagcgtataataatcggtcgtatcgtatccatgctcgctcgactcaaagaccgggccgaggtagacggcattgatatgcagctttaagaaatgcggaagccactcaataattttcgcaatacggttttgcggctctccgccgctgttttgctgcggcgcgccgcagaatccaagcggataaatatgataaaaaacggattcgttgacccagttcataggcggtatcctccttatgccttttcggcaaagcccggacaatgtatgtcctgagccaatttgcatgttaacagtatacactgatttgtaaaaaatagcaattgtaagaaggacattcctcgattgcgttgggaaaatgcaaaaggtgtaataaaagaacttatccaattctgcaaaagtcgcaatgagaaagataagccgctgaaaaaccggcgtccccgctgcaaaccgcgggaacgccggtataaccgtaagatgtgcctgggaacgaattaataatttttggcctgaagctggaaatacgcctgcggatgtgtgcagacagggcagacaagcggagcggactcaccaacatggatgtggccgcagttggaacactgccaaatcacaacgcctgttttcttaaagacctgctcggtatcaacatttttcaagagagccagataacgctcctcatgttctttttcgatcttgccgacctcctcaaagaggtaagcaatcttatcaaaaccttcttcacgggcttcagcggcaaacttcgcatacatatcggtccactcataattttcaccggcggccgcgtctttaagacaggcagccgtatcaggaatgccgtcgttgagcagtttgaaccagatttcagcatgctccttttcattggcggccgtctccaaaaagaggtttgcgatctgaacaaatccttcttttttcgccttggaagcgtagaatgtgtacttattgcgcgcctgggattcacccgcaaatgcagcggcaaggttggcggctgtcttacttcccttaagctctttcatgtcatcttctcctttcaatcttgcaaacaatcaggatttttctgtatgcggctgacacgcctgacagattcctgtcagagtgagcaggacgccatttacagtgataccgggcagggaacgcaattcctcctcaagcgcgccgagcgaaggcagatcgacgtcatagatgcggccgcatttttcacaaagcaaatgtgaatgtgcgtctgtacggccgtcaaaacgatccggcatgccggataatccaatcttcctgatcacgccggtctgcgcaagcagattcaaattccggtaaaccgttcccaagctgatatttgtctcctgcgcgcgtgcgagcgcatagacctcatcggctgtgggatgaatagggttttccagaacgatccggtggataagctcccgctgtctggaataattcataggtttcctcactaagaacaaaaataataatgattattaatttatatttattataacaaaatcaaattatttgtcaagctctttttcaaaaaagccgccgctctgcaaaacagagcggcggccttacccttaattgggtggagcataagcggttgggccgctttgatgctccttgtaatgatgcgcttcctccaacatcatatccttaaccttcatcagacggatctgtgtgctgcgctcattttcatcaagtttcatggtaatatacttgatattttcctgcaattcggggatcataacgtgctcgagcgcattgacacgccggcgtgtcttttcaatctcagcagccataagctggcacgacttttccacctccgcgagacgtaaaagatcaggcagcacgtctgaaagcgatttgatcgcgccgtcaagatcagcggaagtaaacgcgaatccgtaagaatagatgttgtttgcgtcggcagtacgtgtcttgtactcaaatacaggaatctcaacgctcataacgttgcgttgggacgcttcaagatagacctcctgcgtcggcgccatcattgcgacattgagcgtttcgtccgtcataccggcgcgcgccaggacaaagtttttattggcggccgcaataccggattctacccgctcgcgcaacgccttgttttcacgtacaagatcgagaaactgacgcatcagttcatcccgcttatccttaagcagcttatggccgcgcacagcggtgacgagcttctttttgagccgggtaagttccatgcgcgtcgggttgacctgcgtctttgccaaaacgcatcacccctgctttccatagtactcgtcgaggaacttgtcgtcgatacgcttcagctcgctgcgcggaaggatccgcagcagtttccagccgatatcgagcgtttcctcgatatcgcggttggcgtcatagccctgagaaacatactcctgctcaaacgcatctgcaaacttggcatagagcttgtcgatgtcggtcagagcggcctcgccgagaatgaccatcagttccttggcgtcttttccgcgcgaataggcggcaaagagctgattcatcgtattggcgtggtctgcacgcgtcttgccggcgccgatgcctttatccttcagtcgcgacagggacggcagaacgtcgatgggcggcgcgatgcctttacggtaaagttcacgggacaggatgatctgcccctccgtgatataaccggtaaggtcggggatggggtgcgtcttgtcatcctccggcatggtcaaaatcgggatcagcgtaatcgagccgtttttgcccttctggcgccccgcgcgctcatacagcgaagccaggtcggtatacatataacctggatagccgcggcggcccgggacctccttgcgcgcggcggaaatttcacgcagcgcatcggcgtagttggtaatgtcggtaaggatgacaaggacatgcatgttcttgtcaaacgccagatattcggcggctgtcagcgccatttttggcgttgcgatacgctcgacggcagggtcgttggcaaggttgataaacatgatggagcggtcgagcgcgcctgtctcgcggaagctgtcggtaaagaagttcgcttcctcaaatgtgatgcccatcgcagcgaatacaacggcgaacggctcgtcggtgccgcgcaccttcgcctgacgcgcgatctgcgcggcaagattggcgtgcggaagtccggacgctgagaaaatcggcagcttttggccgcgcacaagcgtattcagaccgtcgatggccgatacgcctgtttgaataaattcctgcggatagttgcgcgccgccggattcatcggcaagccgttgatattgagccgcttttccggcaggatctccgggccgccatcgatgggacggccaagcccgtcaaacacacgcgaaagcatatcctcggaaacgccaagctccatgctgcgtccaagaaaacgcacgcgggaattcgacaggttgatgcccgtcgagctttcaaagagctggaccagcgcgttgccgccgtcgatttcaagtacccggcaacggcgtttttcaccggaggcaagctcaatttcaccaagctcgtcataggtgacgccttccacgtcgcgcacgagcatcagcgggccggcgacctcctgaatggtacgatattccttgggcatcagaactcctccttcctgttggccaacgcggcgatttcatcggcaagcgcctgtaaaacggcggcgcattcgtcgtttactttgtcggcggtcacatatttgaaacggccgatacgctcgcgcacagccattttaacaaggtcgtcaacgggaacgcccttattaagcgcctcgacggaggcgtcgtaaaagctgagaaccagcttcatcatcaaaaactgcttttcaagcggcgtgtaggtatcgacgtcatggaacgagttctgatgcagaaagtcctcgcgaatggagcgcgccgcctccagcttgaggcggtcgggagcggaaagggcgtccataccgaccagcttgacgatttcatcaagctcggcctcctcctgaagcagcagcatcaggcgttggcgcatggaggaccagtcctcgttgacatttgtgttgaaccatttcgatgtagtatcgatatagagcgaatagctcgtcagccagttgatcgcaggaaaatggcgctgataagccaactgtgagtcaaggctccagaacaccttgacaatgcgaagcgtcgcctgtgaaacaggctcggagatatcgccgccaggcggcgacacggcgccgattgcggaaagcgaaccctcgcgcccctctttgccgagcgtgatcacacggccggcacgctcataaaactgtgccaggcggctgcccagataggcgggatatccttcttcgccgggcatttcctcaaggcggccggacatttcgcgcagggcctcggcccagcgggaagtcgaatcggccatcagcgcgacggaataccccatatcgcggaaatattccgcgattgtgatgcccgtatagatcgaagcctcacgcgccgcaaccggcatatcggaggtgttggcgatcagtaccgtgcgttccatcagggagcggcctgtttttgggtccttcaattcggggaattcgttgagaacgtccgtcatctcgttgccgcgctcgccgcagccgatgtacacgacgatatcggcctcagcccattttgcgagctggtgctggatgaccgtcttgccggagccgaacggcccgggaacggctgccacgccgcctttggcgattggaaacagcgtgtcgacaacgcgctggccggtgacgagcggcatgtcgggggagagcttgcgctgataggggcggccgacgcggacgggccagcgctgcatcagcgagattttctgctcggcgccgttggccgtttcgatcacagcaacggtatcggtgacggtgaaatcgccggcgctgatcgatttgacggttccgatgataccgttggggaccatgatcttgtgcaggacgacctgcgtctcctgaaccgtgccaaggacgtcgccggccgatacctcgtcgcccactttggcggtgggagcgaaggtccattttttatcgcggtcaagcgaaggaacttcgacgccgcgtgcgaggctgttgccgatttttgcgcggatttcctccagcgggcgctggataccgtcgtagatattggaaatcagtcccggtccaagctcaacgctcatcgggacgccggtcgattccacaggctcgcccggtccaagccccgaggtttcctcgtaaacctggatcgaagcctggtcgccgtggatctcgatgatctcgccgatgaggcgctgttcactgacgcgcacaacgtcaaacatgttggcgtcgcgcattccctcggcgatgaccagcgggccggctacttttttgatcttaccaatgctcatatcgttttttcacctgctttactcttaatcgccgttgaaaatgatatcggagccaacagcctgctccaccgattttttgacgtttttaatgcccatccccgtgttgccggatacgcccggaatcgggatgatggccgggaggcgctcggcgcggtagcggtcgatttccgtttcgagcgcggctgcgagcgcctcggtgatatagattaccgcatattcgccctcagccagcttgcgcagcctgcgggcagcctcggtcggatcggtgacggggaaggtgtccagtccgagcgcggcgaagccgtaaatgctgtcgcggtccccgatgactgctgtcctatacatacatttcccttaccctttcccggatcgacgcctccggcaagtcgttgcgcttaccggaaaggatgatccgcaccgttttgatctcattttcacgcccgaggatatatgcagccagcgggccgatgccgaacgccaaaaactgctgcgggcggatcgattcgatgatgacattgtcgcaccaccgctcaaacgcggagggcgattgttccagcgcgggcaccgcgccggcatagtcggtcagcgacaaatagtcgctgattgcctcatcgccttcagcggcggccttcgcgagctggtatacgtcgagcgaggcgcacggcgcgagcgcgcggcggataaattcaagcggttttccggtgcggcggcagcgcacggccgttttaatatcggccgcggcgacggtcagctccgcatattggcggatcagctcgctgtcggacgcctgcccggcgcgctcgatggcttcaagcgcggcgcggtcaatgataatgtcgcaaagctggccgtcgcgcgtctgggacagggcgttgtacgcttcctctgcgggtgcgcgcatcgcctcgggcagcgcgccgaactccttggcgcgcacagcctccaaaatggcgccgctgtcgacggttccatgcgagataaagacgccgaaatcgctttcacccgtgcagacaagcttgattgcggccttcaggttgtgataatcgttggcgtagaggaacacgtcaaacacggacatatcctcgaccagctcgccgatcagattccaggttttttctctctcggcggccaacaggcgcgcgtcgtccgcggcgacttctccgtcgccccatccgcggtcggccagcagacgcaggcattcgtcatagctcttggccgcgagcagctgatcgatcgcctgggcattgagaagcgtcagctcctttgaacggatgcgagcgaccgcatatgtgtataatgaatcggacatgttaaacctcccttgtacacgccgcagacagggaagtaccgcggcgcggcgcaaaatgcgcgttatgcgaacaggagcgcctgaacctgatcctgcagggtttcgcgcgcggcgtcgataagcgccgcaaacgagcagttttcctcaatgccgccatagacgagcacaaagccgccgtcgatgccgcgcgtttcgtcgctgatgcgcagcgtgcccttggcctgcttggcgagagcgtcggcaaagctgtccggcagacgttttttgtcagcgggattgaacagaatttcgccgtcaagcggcagggaatacttgccgatcattttgagaataagcgcgaaatattcctgttcgggcagggcgcaggcggctttctgcgcttcggcgatggccgaagaaatgatttcctgtttggcttcaagcacagcgcgccggcgcgcaagcgcggcggccgattttgcggactcgtgcgcagcggcgacggcagccgcggactgggcctcaatggccgcgacctgggcgtcggtttcgccgcgcgcttgctccataatctgccgcgcctcgtcccgcgcccgcgcgagggcggcctgcgccgcctgctgcgcatcgtcctggatctgctgtacaattttttccaatccggtcatggcagaattctccttactataaagtgcggatgtttccgccgtatcagatggccaggctgccgacgccgaagatcgagagaatcgagataagcagcgcaaggatcgcgtacgtttcgaccatcgccgggaaaatcatcgccttaccgaatgtctcggggcgtttgcagatcatgctgatggaggcgactgccgcgcgcgcctgacggatcgcggaccacagtccgacaaagcccatcggcaggcaggccgcgagatagagcaggcccttgatgagcgagatgttggagtcaccgcccatgatgccgatctgtgtaagcgtgataaaagcgatgagcaggccataaataccctgcgtaccagggagaagctggaggatcaggaccttaccaaagcggttgggatcttccgtcaccgcgcctgcggcggcctcgccggccatgccgacgccgattgcggagccgataccggccatcagagcggccagcgccgcgccaagcaatgcaaaagcaattcccatagaactcatgtcagatttcctccttgaatttgtaatatttagtatgagcggcaaacggcgaaaacgcgcgtccgcccccttcataaaacttgccgaagaactcgacgaattgcagacggttcgtatggacatacgcgccgagcaggttgatgccgatgttcagcgtatgtcctaccagaaataccaggataaacatgatcgcgccaaaaatgccgccgccgcccatgctgcccattttgttaaagacggtcgcaataacgccggtcgccagaccaagcgcgagcaaacgggaataggacaggatatcgctgaggtagccggtgacgttgtagacgccgtaaaggcccttgagcagacgcttgaccgggttgcgggattcgcgcccggacgtcaggataatgcccacggccccgatgcccgcacagacggccgcgaccgtggcgacaatgggcggcagcgtaaaggaaaggccgagcatttctgtaatcatgctcatggtcagcagataaaagataccgccgccgacgagcagataccagaacacaacgtcatagatcgcatccttgatctggccctcccgggcgagctgataaaatttgattccaagcccggtaaacagatggatgatgccgatcaggaaggaaaagacgagcagacgcatcggctcgctgaccggctcgaaccacagcggggataatttgaagtcggaatggaagaacgtcgaagcgataacgcccacagcgtccccaaagaagctgccgaacagtacgccccagaagatggtggacaggccgcagaagaaaaacattttgatcatctttgcgatccccggctccatattcttgtacttggccattacaacgccgcagccgattgccatcacaagcccatagccggcgtccgagagcatcatgccgaacaggatgtaatagaaaaacgacatgatcgtcgtcgggtcgatttcacccctgccgggcaggctgtagctttcgacgaccgtttcaaccggctcggaaaacgaattgtttttcagcacaaccggtacgtcctcgtcgggaccgggcgtttccaagcgtacagccgcgtcaaatttgccggtcagctcgctttcaacggccgcagcgcgtccggccgtcacataaccggacagcaggaacgtgcgttttgactgcgcaagccgtccgatgacctcgtatttttcagcgcgcagccgcagataatcggttaaaaaccgcaaatcgccgcgcttgccggcaagcccttcaatctccttctgcgctgcgtcgatggcgctttgcgcggcggcggcagcatcgttcaagagcttttggcgctctgcgggcgattccttggccggagaagctggacgtgagaatccgcaggtccgcagcgcctcgtcgacagcggccgcctgactgcggtgcgtcacaatgaatacgcaggtctgatcctgcgaatggctgacaagatcgatgtgcaccgccgcttcgggcgcagcctgagcgatgcgcgcgtaaagagcatcaagcggcacatcgtcggcaaaggaaccgataaacgccgctgtcgaccgtgtgccggaaaagcgcatcgatacgtcaagaccgagccaaggcgtcaacgcgtcgagctgcgtttgcagcttgagaatttcagcgcggttttcagcgatcgttcttgacagcgcgtttaatcgccgcgccgtctcaagcgtctggccggcgccggcgccggctgcttcgtattcctgcgttgtcagagcgcgccgtccctccagcatggaaagcatgggggtcttttcgggcgcataggtatcaagcacctcaagggcggatgtagccgccgcaatgtccttttcaaactggatgcgctgcgctgcggtgtcagatttttcgaaaacgccgtcctccaggacgagatcggaaatttcgacgacgccgcgccgctgaagcgtctcaaggatttgtttgcggtcttttttcagcgcgcatatgctgatgcgctgcatttgcagcaccgccataaaacggatgcctcctttacagtggaatgggtccggccgctataccagctcggacaggatcagccgccgcacctcgtctgcccgggaggccgcgccctcgcgcagcgccgcgacctcctgacggaccgcgtcgagcgcctcgcgctgcatttcatcgccctctgcgtgcgctgcggccagcgcggcgtccgcctgggcgcgcgccttggcgattcgctctttggactcggcgtccgcgtccgccctggccccggcgatcgccgcctcgccctgacggacggcctcctgctcagtctgctcggcggcctgctccgcctcgcggatggtccggatggtatcctgctccatagtatcaccacctgtttttgtcttttaacattttaagcccgaaggcgtaaaacacttatggttagtatacaacgaaatggaaaaataatcaatgttcctcatgattcagcaaccaatgaagtgataaaaaattatcaataatgaaagctgaaaacgctttgcaggcaaaataaattgagataaagtctgactatagctataattttactatataatggtgttggaatcaaggaattttatagaaatccttcaagtttcaataatattttcgcgcggaagataaaattgggaataaatcacatttacaagtctgaaatcagtccctattttacaaatgttaaaatttacataaaaaacagttgtattttggaaaatgatgtgctatattgaatacataagttaggatctttatgttttgacatctccacaccctcaccccctataggaaaaagcggcttgtaaaatcggttgcaggccgctttttcctttgtttttttgtggtggtcttgttgacatttggattgtatcattgtattattgtaccgttggattaatacaattgctaaaagccagaaaatccaatgttttgaagtctgcacccgtatgcgctcgttttatcactgaggtgatttgccatgccgcatacacggggattggcagaaacataagggagttgataagttatgacggaaaccgaggagaaagtggggctgcagccggctccggagacgccgccgctgccgcccgcgccgatcagcaagcatccgggccgttttacaagccgcaagggcaaaagaaagaaatttattgtgcctgcggtgattgtagcgattgtcggtgttgtcgcgtggaagatgctgaccagtgagccgccggtcgtcccgacggccagcacgccgttggaaaagatggatctggtcagcacgatcagcgtgaccggtacggtggagagcgcaaacgaggggcttgtctattcgaatctgaacagcctggtgacagaggtcggcgtcaaggtaggtgaccgtgtcgccgcaggcgatacgctcgcgcagcttgacacatcagatctgtcgttgtccatcgcggagcagcaggcacagatcaacaaacaggtcaagctgaacaatcatgcgcttgaacagtcgcagaaggcgctcgacaatgcgaaaagcgatatcgcaaacgacgttgacgcggatttgatttcggcagaaaacgccctcaagctggcgcagcaggagttgaacagcgcgcgccgcgaccttcaggatcacgaggacgaccttgaatacgccgattcggtgatgaacgatcttgaaaaggaactcaaccgcgcgcgcaacgagatgaacgacgcggagcgggaacttgagcttgcggaacgcgaggagcgcgaaaacggcacgccggttccgcaggaagttcgcgaacggtatgaacaggccaaggaaaagtatgacgcggtcaacaaggaatgggtcgaggccgaccgttcctatggcagtgatatcagcagctacagccgtgcgtaccgccaggcgcgcgtcagctatgaaaatgctttagcgaacaaaaaggctgccgaaaaccgtgcgagccgaaaccttgacactttgcaggatgaaattaccgggcagcaaatccaaaatgacgtaacctccatgcagatcgctctgcaaaagtatcagaaggattttgccgactcgacgctcaaggctccgatctccggcacggtcacggctgtttacgccaaggagggcgcgcccgcgggcgggttgatgtttgtcgttgaggatacggacagcctggtgatcaaaacaaagctgaaggaatacgatatcgcctccgtcgaagtcggcatgcctgtcgtcattaaatcggacgcaacgggcgagcaggaattcatggggcatatcagccacatcagcccggccgccgtcaaatcgtctacaggcgagatccagactgagggcagcgttgaatttgacgcggagatcacgcttgacgagcaggacacgggtctgcgtgtcggcatgaatacacgtatgacgatcgaaacagagcgcaaggatcaggtatgggccgtcccgttcgacgctgtgacgacagatgcgcagggacaggatatcgtctatgtcgcccgcacggatgaaaacggcgtcacaaccgcggctcctgtcccggtgacaaccggtatggagacagatttctacatagaagtcaatcccgatcagctcaacgcgggcgacttgatcatcagcgatccaggtacggttgttcccggcgtgccgatcaccctggcgaacggcgtgacggcggaagctgcggccgttcaaacggtatccgaagaaccgtcgcaggccggcgaaagcagcgctcccatggcggacacggatacggcggacgcatcctcagatgcgtccgaagcggcctccgctgcatccgcttcggatgaaagcgccggagggcaggcggattcctcctccgcggcgtccgcctcgcagggggggctgaccgatggaacatgaacagctaacctggagccaagcgcccgctgatgatctgatcattgatatgcggggtatctacaagcggttttatattggacagccaaatgagctggaaatattacgaggcattgatttgcaggtgaaaaagggcgagtttttatcgattgtcggcgcgtcaggctccggcaaatcgacgctgatgaatatcatcggcgcgcttgaccgcccaacagagggaacttatacgctggacggcgtgccgatggcggatgtgcctgacgatatgctgtccgagatccgcaatttaaagattgggtttgtatttcaaaccttcaacctgattccccgtaccaccgcgctgcgcaatgtggaactgcccatggtctatgcgggcgcgcggcgcagcccttgtaccaaacgcgcgaaggcgcttttggaaattgtcgggatgggcgagcggatgaagcacctgccaaacgagctttcaggcggccagaagcagcgtgtagccatcgcgcgcgcgatggccaacgatccggcgatcattcttgcggatgaaccaaccggcgcgctcgattcttcgaccggccgtatggttatggatattttccacgatctgcatgagcggcagggcaaaacgattgtcctgattacccataacccggagctggcggcggaaacgcagcgcattgtgaccatcagcgacggccggatcattgacagcagggaggaggatgcacgccatgcagctttttgaaaacatcgcccttgcggttgccggactgcgcgccaataaaatgcgtgcgcttcttacgatgctgggcatcatcatcggcatcgggtcggttatcacgatcgtcacgcttggcgacgcgatgacgggcgcggttatggacgtattcaattcgctcggcgccaacagcatccagatctatatcaacgataagcccgacgaaaacggcaatattgattggtcgcgtccttacgaggacagcgattatatctcagacgagatgatagacgcatataaggagcggttcggcagcaaggtcgaagccctggctgtttcagagagcgtcggcaacgggcaggcgcagaatggccgccgccaggcgcaggcacaggtaatcggcgtcaacgataatgcgctcggcatccagaatatcgatatcgttgcaggacacgatttaaacgagcgtgaggtcggcgcgggcaaatacgtcgctgtgatctccgacgcgtttgttgaggatctgtttccgaatacgacgccgcagcaggcgctcggacgcgaagtgaagctgcgtgttgcgcgcggccaatatacatttactgttgtgggcgtttatcactttgaggtcaatggtatgatggccggaatggttggcagtacaacatccaatttatttatccccgtttctgtcgcaaaggaaatcgcagatattgaccgcggctattccgtcatacaaatcaaggcgtcctccgaagtgacggatacggtggcgttcgcacagcagtcggaggactttctcaacaggaccttttaccgcgacaacaattatgtcgagctgatggccatgagtatggacagcatgctcgaccagatgacaagcacaatggacatgatgaaggtggtcgtttcggtcatcgcggcgatctcgctgcttgtcggcggtatcggcgtcatgaacatcatgcttgtttccgtcacggagcggacgcgtgaaatcggcacgcgtaaggcgctcggcgcgaagaattcggcgatccgtatccagttcatcgtggaatcgatgattatctgcgtgatcggcggtgcgattggtgtggtgctcggcacaacgcttggacgcgtcggttccctggcgctcggtgcggcggcctggccgtcgccgtttatcatccttgtggcggtcggcttctcgatggcaatcggtatctttttcggttattatccggccaataaggccgcgaagctcgatccgatcgaggccctgcgctacgaataagcagttggatgaagccccatcctcaaaaagataggcccgggccgcgtgtccctctggtgcactgcactgaaggacacgcggcccgggccttatttttctgtagcttgcccactgttcgcggcacagcctgtaaggccgcagtgtcaaacccactgtttgcggcgcagccggctaaagttttttggcatacctttttttcaaaaaaggtatgaagtttttcgccaaggcattttttcaaaaaggccggaaaaagcgggaggggggtcagccgtggaacagcttttttgtctggtattttggttcgcaggtgagattgacgccaagcttgcggaaggtggtggaatccacctgtgaaagaatgacggttgaatgcgcttcgcagccgcgcagcttgggaagctgcgccatagccagctcggcggttggattggtcgcagcgcaaattgaaagcgcaacaaggatttcatcagtgtgcaggcgcgggttgtggttgcccagatgttttgttttgaggttttgaatcggctcgatgatgatcggagaaatgaggtgaatgtctttttgaatccctccgagcaccttgagcgcgttgagcaaagcggcggccgaagcgccaagcaaagccgaagttttgccggaaacgacccgtccgtccggcagctcgattgcggctgcgggcatcccggtcgcttccgcttttttcagcgcgcaggcgatgacgctccgatcctcgatacaggcgccggcctgattcatcagcagctcaattttgtatacgtcgttttcatcaacaaatccctgccggaacccacaccgcgcagcatagtaacggcggataatttcctgcttggacgcgtcgcagacggcttcgtcgtcgatgatacagctccccgccatattgacgcccatatctgtcggcgatttgtagggggagccgcccgcaattttatcaaagattgcgttgagcactggaaaaacctcaacatcgcggttgtaattaaccgttgtgatgccatacgcctccaaatgaaacggatcgatcatattgacatcgttgaggtcggccgtggccgcttcataagcaagattgaccggatgcttgagcggtaaattccagatgggaaacgtttcaaactttgcatacccggctttgatgccgcgcttgtattcatgataaagctgggaaaggcaggtcgccattttcccgctgccgggtcccggtgcggttacaacaacaagcgaccgctgcgtttcaatatattcgttgcggccatagccctcgtcgctgacaatcagcgggatattggatggataacccgcgatcggataatgccggtagacgcgcagcccaagcgattccaggcgtttctggaaggcttcagccgccggctgcgcgttgtattgtgcaattacaacgcttcccacgtacagcccgatgccgcgaaacgcatcgatcaggcgcagcacatcgagatcatatgtaatgccaagatcgccgcgcaccttgtttttttcaatatccgacgcattgatgacgacaacaatctcgacatcatccttcatatgcagcagcatgcgcaccttgctgtccggctgaaacccggggagtacgcgcgcggcgtggtaatcgtcgaacagcttgccgccaaattcaagatagagttttcctccgaaacgcgcaatccgctcctggatatgctcggactgtgtgcgcaggtagcgttcattgtcaaacccgattcgtttcattctgcttcctccaaataacactctcctgtaaaaagccggctgcatatcacaattggcggattttttaaaataaagagccgccgacggaagatatgaagcaggctctggccgcagccacgcactggaaaagcccggcggaacccattccgccgggctgtctgcacgttgggtgcggcagcttacgccttaccggcgcagccaagcacttcattgatcttatgagaaaccatgtccttgacggcggtgcgggcaggtgtcagatactgacgcggatcgaaatgatccggatgctcggcaaagtatttgcggatcgcagccgtcatggcgacgcgcacatcggaatcgatgttgattttgcagacggccatcgaagcggccttgcggagcatatcctccggaatgccgatggcgtccggcatctggccgccatactggttgatgaccttgaccagatcctgcgggacagacgaagcgccgtgcagaacaatcgggaaaccgggcaggcggcggctgacctcctcgagaatatcgaagcgcagctgcggcttctggccgggtttaaatttgtatgcgccgtgactggtgccaatggcaatggcaagcgaatcgacgccggtcttggtgacgaactcctcaacttcgccgggatttgtgaactgcgcgtcgtcggcgtggacgttgacatcgtcttcgatgccggccagcttgccaagctcggcctccaccacgacgccgtgcgcatgggcgtattcgacaaccttgcgcgtctcggcgatgttgtcctcaaagctgcgcgcggatccatcgatcataacggacgtaaagccgccgtcgatgcaggttttgcagatttcgaaatccgcgccatggtcaaggtgcagcgcgatcgggatatctgtgtcggcgacagccgcctcgacaagcttgacaagatagatatgcttggcatatttgcgcgcgccggcggaaacttggaggataacgggcgccttcagttcggaagccgcctctgtgattccctggacaatttccatgttgttgacgttgaacgcaccaacggcataaccgccctcatatgcctttttaaacatttcggttgttgtaaccaacggcatgataaacaactcctttattttgaatggattatagatttcccatttttattataccattttcctcacaaaagacaaccgcttttgcaggctcccaaggactttttttgacgctctcgcgcatagaaagcggtgttaacgccttgtttgcgtaaatttccaaatggaatacaaacaatccccgccgcataaaactgcggcggggattgtttaagcctgcaaataacgcgaaagaaactcgcgcgtgcgttcgttttttggggcggtaaaaatctgctcgggcgatccttcctcgaggatgatgccgctgtccataaagacgacgcgcgaggaaacgtcccgcgcaaagcccatctcatgcgtgacaacaatcattgtcagccctgttttggcaagccctttcatgacctcgagtacgtcgccgaccatctcgggatcaagcgcggaggtcggctcgtcgaacagaagaatttccggatccatgcacaacgcgcgcgcgattgcgacgcgctggcgctgtccgcctgaaagctgtgcgggcgacgcgcccgcgaactgggacataccgaccttttcaagaaaagcctcggcttttttctggctttcctcacgactgcgtttgagtacggtcatctggccgatcatgcagtttttaagcacgctcatgttgttaaagaggttaaaggattggaacaccatgccgacgcttgcgcggtgcttattgatatcgatgtcgcccttgaggatgtccttaccgtgaatcaagatctcgccggcatcgggaatctcaagcagattaatacaacgcagcagcgtcgatttaccgcttcccgacgaaccgatcaccgtgatgacatcgcccttatcgatatgaaattgaatatcattgagcacctcaagccgtccgaagtgcttgcggaggtttttgatttcaacaagatgctccatcacacttactccttccgcgattgattggtttttcctgctgcaagacgggcttccgggaccgtttgtgacgacggatagctcgacggcgcgcgtcccatgcgcttttcaatcacatgcaggatgcgggtcgttgtaaaggtcaatataagatagattaaagccgtaaccaaaaatgtggcggtgaaatcaaagatgctgcccgcgatcttgtttgactggaaaaacagctctgttacagagattgcgttgaggacggacgaatccttaatattgacgacgaattcgtttccgatggcggggaaagcgttcttgatgccctgcggcaaaacgacgtgcagcatcgtctgcgcggaggtcatgccgatgctgcgcgcagcctcggtctggccaacatcgacagattggatgccggaacgcagaatttccgccatataagcgccggtattgatcgaaataatgcagataccggcgacgacgggcgtccagttaaagacagacttcaacccgtagtaaagaaacaccgcctgcaccatcatcggcgtgccgcggaagaattcgatataaacacaagcgatcacattgacgatgcgcttcacaatttttgtggcgaatgaatcgcgcggctcgatttttgaggagatcgaccgcgcgctgccgacgatcagaccgatcacaaggccgatgattgttccggtcagagaaacaagaagcgtgatcttgatgccggcccagaacatgggccagtatttcccagcgatttggacggcggatgcaagcatatttaaacaaccctacctcttttatggcttatttgaaaatagaatcattgccggcttgtttgcagacagcaggagaatgcaaggcaaaaaatgagggagtcctttcggattccgaggccatttaacgcggcattcgccgctatttgtagaataagacggaaattctgattcttcaaacagcccctagtcaacttttatgaaagacatcggccaaagccggtatcctccggctttggccacgtggcgtcctctgttcagcctcccgcttacagcgggaggttttaaattggcgcttgtcgctgaaaacgcctttattcctgcgccggctggcggctggtggcgtcgatcatccactgctggcgatcctcctcggagacggaggccagcgcgctctggatggcgtcaagcagagcggtgttgcccttcttgacggctatggaaacggaggtgtcggcctcaaagccgctgccctcggcaaactcgacgtatgtcagatccggattgctggcgacaacgccggctgcaacaggcagttcggctgtgagcgcatcgacctcgccgctctgaagcgcgacaaccatcagcggataagtggccagcggcgtgacatggtcgacaccctcaatttgatcgataacagtgtcgtaaagcgtgttgagctgaccctgcaccttgcggccggatagatcctggatgcttgtgatgttcgtcaggtcgctgtccttgcgcacgatgacgaccatcttgctttcatagtacgggtcggtaaaatcgacgttttccctgcgctcgggcgtggcagtcatgccggcgatgatcgcgtcaatctcgccgttgttgacagccggctcaagcccttcccaggcgatcggcttgacgaccagctccaggccgagctgctcggcgatgtatttgcccatgacgacatcataaccatccgcgtaggaggcgctgccaatatcgacagccgtgtccgttttttcaagctgtgtccagttaaacggcgcataagcgcattccatgccgattgtgaatttacccggggttacggttgtgagggacgcatcgccgcctgcggcttcgcttcccgcagcctgggaggcggcgggcgcggcgggagacgccgcggaaggcgcgctgctggatgaggaaccggaactgcacccggccgcgagcatcatggcggcggcgagagcgcatacaaacaactttttcattttttcattctctcctgtgctttgtttttgtgtgcaatcgaagctgccggtcaagatctgttttctaaaacaggaacaccggacggccccaaatttttgctagggaaaacccttctgttacagtttatgttgatggcgcggtaaagtcaagagtttttgcaggtttctgtatgttttcatcatagaaacgtattttttaccgattatattttgcatatatgcacgattttttgcaagaaaaaaaccgggcggttcatttcggcaacagcgcgaaacgttccgcccggcgcaggcgcgcgtcccggaaaaacaggctttgacgcggccctcaatatgcaatccggtcgaggatgccgccgagcttggccagcgcgacgccgtaatttgtgatcggcacgcccgccgcgcgcgctttctcaatgcgcgcgagcacatagcggcggttgaacatgcacgcgccgcagtggataatcagggaataaccgcttaaatcgtccgggaaatccggtccgctgactatgtcgacggcaagctccccgctgatacgcgcgcgcagaaggcgcggcagcttgacgcgcccaatatcctcctcgagcggggcgtgcgtgcatgcctcggcgatcagcacgcgggaatcctttgtcagcgcgtcgatggcggcggcgccctcgacaaacgcgttgatatcgcccttgacgccggccatcagcacggaaaacgaggtgagcagcgtttgcggcggctttttcgcatagacctggggaaacgcctgggagtcggtgatgatcaggcgcggcgggcgcgccagcgcggcaagccccgcgtcgaacttgtccgctgtgacgcctataacgacgcagcggttgtcaagcaggtcgcggatcgtctgtacctgcggcaggatcaggcgtcccttgggcgcctggatgtcctgcggcatgacgagcagcacgacgtcgccgtcgctgacaagcccgccggtgacgctctttttctcgtaatcctcgggcatctggcggatgacggcctcgatcacatccttgacgccggcgccgtcctttgccgaggcgacgactgggaacagcccgaacgcggtgtgcacggcctcggcgatttccggcacatttggcaggatatccgccttgtttacaacggcgacgaccggcgttttctgcgcgcgcagcgcgccgatccattcctgttcctgcgtcaggtcggcgtcacagaacagcatgatggcgacatccgtctttgcgagcgcgtcgcgcgttttctcaacacgcagcgcgccgagagatccctcgtcgtcgaagccggccgtatcaatcagcatacacggtccgatcccatgaatttccatcgccttatagaccgggtcggtcgtcgtgcccgctatgtcggacgtgacggccgtgttctgcccggtgatggcgttgatcagcgacgatttaccgctgtttcgtttaccaaagatgccgatatgcagccgattggcgctcggcgtgcttgtcaggctcatgatgcttccctcgtttcagaagcggaagtcgcgctttccggcggcgatctccgcgagatgttcggctgtgaggcggcgcaccttttcgttggggatgcacgggagcatctgggcgatcatcgcctcccccttggcgcgcgtttcgggcgacgcgtagtcctccagatattccttgagcgtcatcagcgcgttggggtcgcagcagttgccgatctgctgtgatttgaccagatgcatgaagcggtcgccggtgcgcccttctcggtagcaggcggtgcagaagcttgggatatggccgaggtcgagcagccagccgactacctcgtcgagcgtgcggttatcgctgacgtcgaactgcgaggagttttctgtttcgtcctcggcgtagccgccgacgctcgtgcgcgaaccgccgctgagctgcgagatgccaagctccagcactttttcacgcgtctgctgcgtctcacgcgtcgagatgatcatgccggtgtaggggacggcgatacgcagcacggcgacgatcttctgaaagatttcatcggagatgccgttgtcgaattcatccgggtcgatgtcgtcggcggtgcgcacgcgcggcacgctgattgtgtgcggcccgacgccgaacacggcttcgaggtgctcggcgtgcatgagcagcccgacaaagtcgtatttataaaggttcagcccgaacaggacgccgcagcccacgtcgtcgatgccgccttccatcgcgcggtccattgcctcggtgtggtaggcgtagttgcttttgggaccggccgggtgcaggtattcgtacgattccttattatatgtctcctggaacaggatataggtgccgatgccggcttctttgagcctgcggtaattttcgacggtggtcgccgcgatgttgacgttgacgcggcggatcgcgccgtttttatgcttgataccatagatggttttaatgctttccagcacatattcgatcgggcagttgaccgggtcctcgcccgtttccagcgcaaggcgcttgtgccccatgtcctggagcgcgaccacctcgcgtacgatatcctcctgtgaaagctgcctgcgcgcgatgtgcgtgttgtggtggtggtacgggcagtaccggcactcgttgacgcagtaatttgacagatacagcggcgcaaacataacgatgcggttgccgtagttgcggcgcttgacctccctggccagcgcgtaaattttttcgatgctggccggatctccgcattcgagcaggactgccgcctcgcggtgggaaaggccgccgaggcgcgcggctttttcaaggatgctttcgatcagcgggatattgttcctgttctccgccgcgtatcgcagcgtctctttgatttcagcatcgtcgatgaactcctccgccttttttgatttgggatcatacatgccaatcactccttttattcggggacaaaatcgccgcggtcgaccgccagctcatagccgatggaacgcatccggttctgcaggcaggcgcggcactcggccgcttcgtcccccgtgcagattttgttgtcataaagcgcatattgttttcgcacgccgaccggcgagagattcggcatcacgacattcgccccggcaaggacgccgcgttcccggccgtcgggcgcgatggtgccgagcgccgtcgtagcgggcagcagtgcgtttggcagaatcaaccgcgtgagcgcgaccatcagaagcgtctgccgcagcgttccagcgggaaaggcggaaaatggcgtctgatgatgcgggataaacgggccgatgccggccatctgcggtgaaagctcatgaaggaacagcagatcatccgccagattttccggcgtctgatacggcgagccgaccatgaagcccgcgccgacctggtagccaagctccttgagcgaccaaaggcactgcctgcggcgctggggcgtctgctccggcggatgcaggcgccggtaatgcgcgggcgaggcagtctcatgccgcagcagataacgatccgcgcccgcctttcggtaaagccggtaggacgaatgctccttttcgccgatggagagcgtgacggcgcagtccggccaggacgatttgatggcgcggacaagttcgcagatgcgttcgtcggtgaagtacgggtcctcgccgccctggagcacaaaagtacgaaagccgagcgcatagccggcccggcagcacgcaaggatctcctcctgcgtcagccggtaacgctctgcctggcggttgctgcgccggatgccgcagtaatagcagtcgcagcggcagtaatttgtaaactcgatcagcccgcgtgtgtaaatgcggttgccaaaacggctgcgcgccgtttcgcgcgccgcgtcgaacaggtaaggcatgtcgccgtcgctgatttcccggatcagaccggccaactctgcgcgcggcagcacgcgctcgcgccgcagcgcgtcgatcagcccgcgcacgcgcccgggtcctttccggcgggtaccttggagtaaaccgttttgatgctgacgccgccgagcatgccgagcttgccggaaagggcgctgatgagatcgcccggcgcgtcgatgacgacgctgatgatgcagacctccttctgccggtagggaatgcccatgcggccgacaatataaggcgcgtattcatgcagaacagcattgatgcggtcggctgccgacggctcctcgacaatgatgccgatcagcgcgatgcgcgtgtccataaaaatcacccttttgcaattgtttttgcgcggctgccgctcaaaaaaaaaatgccgcttaagagcggcgtttttgcaaaacaaaacttcatgcgcccaaagcgcgtcgcgtgaataagcgagcgccggacgtaaaaaagtttgcacatcattttcggatgcccggagggcgggaaaatggcgcatcattttttgtatagcaaaatacaccgcctttccagttgggacgaaccctcccggtgagacgattatgatggaaaaagcctttttccgcgagaaaatccccttggaaggcaggcattctgtttttaagcaaagcgcgcctgccggtaaaccgacagcctcactataccataaatcgaatcatttggcaagacgcggccggcgatttgccaaatgaacaagcttctggtatactcggtttcagcgattgacgacaggagggctttaaaatgatcagagagattacaacagcggacagggaggtttttttacagcttctcgacgagttttaccattccccggctgtgctgcacccggtgccgcggacgtattttgaacgcacgtttcaggaggtcacttcgggcagcccatacgcccgggcctatctgctggaatgcggcggcgcgccggccggctatgcgcagctctccttcacatattcaacggaagccggcggccgtgtgatctgggtggaggaactgtatgtgcgcccgcagtatcaggggcgcgggcttggcggcgcatttttccggtttttggaggagacgtatgccgggcaggcggcccgcatacggctggaggtggagcctgacaacgacggcgcgcgccgcctgtatggccgcgttgggtttgaggaattgccgtatatgcagatgtgccgcgattttccggctgaatgacgcgcagcgcacaatgaaaggcccggatgtccttgtggtgacatccgggtctttcttgctgtgcggccgcgcctgctattcatcgcgcatacggcgccggttgcggtcattataggaggcgcggtcgcgccgctgcgacggctttgggcggaaaaacggcttttcccggccgcaggtaacgcctccgcgcgcggcgtaacgcggcttttcggacgtgagtgcaaagtgcacctccagcccgcgtatcctggtggaacgcatggcctcaagcactgtaagcgcgtcgttttcgtacagctcgatcagagaactgtcctcaaagatatcaatttttccgattgcccgcgcgggcaggccggacgcgtcggcgatagctgcgacaaaattggcgggcgttacgttctgcgcgcgtcccgcgtcggcgcgcagcaccacacggcgtccgccgcgcaccggacgttcgccgggcgcggggattttcaaaacgggaatcagctttttgtcgcgcgcggcgatcatctgcgcgagcgcacaggcgatatcacgcatatcgcagccgcgttcggccgcaatcgcgtcaagttgttcgccccacttgccatattcatccgcctcgagcgtgcgcgcgacgcgcgcggcgaatttttcgcgctttttccgcacgatttcgtcgcctattggcagcggggcttcgcggatatccgcgttgataaagcggcgcagctgacggattgtatctacctggcgcgcaccgcatacaagcgtgtgggatatgcctgtccggccggcgcggccggtgcggccgatacggtggatgtaatgctcgaactcctgtgggatgtcaaaattaaagacagcttcgatgttttcaacatcgatcccacgcgcggccacgtcggtcgctacaaggatgcgcgtcttgccgtcgcggaagctctgcataacctgcgtgcggccggcctgcttcatatcgccatggatgccgagcgcccgaaagccgtgatcgctaagatattcagtcaggctgtcgaccattgccttggtattgcagaacacgacagcgcgtttcggatcatgatattgaagcaggagattgagcgcatccatcttgcgcgcctgcggcacgcggtagaaaaattgctcgaccgccgcgatggtgcgctgacccgtgcggatgtcgaccgtctgcggatcgtgcaggaatttgtcggtgattttcagaatcgccggcggcatggtggcggaaaacaggacggtctgacgcgtgtcgggcgtttcagccagaatcgtctgaatgtcgtcgagaaaacccatattgagcatctcgtccgcttcgtcaaggacaacggtgcgcagatcgtcaaggcgcagcgtatggcggcgcatatggtccatcacgcgccccggcgtaccgattacaatgttggcggcgcgcagcgcgcgtatttgggcgtccatcggcgctccgccatagacagccgcgacacagacgccaggcttatatttggcaaatttgcgcatctcgtcggcaatctgcatggcaagctcgcgcgtgggcgaaagcaccagcacctgcggcgctttcagtccgctttcgatccgctctacggcggggatgccaaacgcagccgttttaccagtgccggtgctcgagcggccgattacatcggccccctgcatcagcaaggggatcgcctgcgcctggataccggtggcctgcgtataattcatatcgctgacggcctgcacaagctccggcgacaggccgatgtcctcaaattttgtttcactcataacacgctcactttccgggtcaaaaaaacagggcgttgccgccaaatgtggcagcggcgacccggacgtttgataacccttatctcaacggtggtttttgtatttgcaggaagaaaaaatgcatttccagcggcctggtttcttaaataatgttttggatatctttcatatgatatcacaaataaaaatctttgtcgccactcatttcttaaattttatgtgaattttttgggtttaatcttatacagattgtggtaattacccaaatcatgtatagatgggaaaatctgtttgcaagggatgaacgaaggtcaaaacaaacggccccgcgtttgatcgcggggctgtttgatgaaaaagtttattcggaaacctgctccaggatcagtttgtgcggagcggcgatccgttcatcataacaggagaaggtaacgtccagatgcgcctgagacagctttggcgtgaaaaggctgacgaggggcgcaacgataagggatgccacaatcgcaatggcgccggcggaggtcggcgcggcaaagggtacgaacaggttgagcacattgaagcccacgccggtaataaagcaggcccagacaccggcggccgtcgcgccacgccagaaaagcccgtagacgagcggccccagaaaagagccggccagcgcgccccaggagagcgacatcagcgaggtgatgaggttgttgggattgagcgcgagtacaacggaaagcgcgacgaaaaagatacacagcgccctgatccagcgaagctgtgtcctgtgccccattcccttgaaaaagacgccgccgagaaaatcgagcgtgaaagtcgaggatgaggtaatgacaagcgaggaaagcgtcgacatggaagcggacaagaccaggatcatcactacgccgatcagcaggtccggcaggctgcccgcgagcatttcagggacaatgttatcaaaaacaggctgcccggacgcaggcggcgtgtaatacagacggccgaacgcccccataaaataactgccgccagcgatgataagggcaaacagtgttgaaataatggttccggctttgatcgatttttcatttttaatggtataaaacttgtgaaccatctgcggcaggccgagcgtgccaaggcttgtaagtacgacgacgccaagcaggccgagcgggtccgggccgaaaaacgaaacgaacgcgccgcccagtcccggggcggtttcgcttgggacttgggagagctgctggaacgcgctgtaaaaaccgccgcgtccattgagaattgaaacgacgaccataacgatgccggccagcatgacaacgccctgcacaaggtcgttgagcgcggccgccatatagccgccgacgacgacatagatgcctgtgagcacggcgattccgatgacgcaccatttaaaatcgatgccgaaggccattgcgaacaagcctgacaggcccttataaaccgaagcggaatacggcaccagaaatacgaaaatcagaacggacgaaacggttttcagcgcggggcaacagtaccgttttgcaaaaaaatccggcatggtggccgattcgaggtgttttgtcatgacgcgcgtgcgccgtccgagcagcacccaggcgagcaggctgccgatcagcgcgttgccgatgccgatccaggtcgcggccacgccgaaattccagccgaactgtccggcatagccgacgaacacgaccgatgaaaaataggatgtgccatatgcgaacgctgtgacccacggcccgacgctgcgcccgccgagcacaaagtcgccgacgctgccggcgtgccggcggcagtagacgccgatggcgacggtcacagcaaagaaaatgacgatcatcagaattttttcaaacatggctatgccctccctgtattttggacaacaaaaatcccccgccctccggctgtccggagggcggggggaagtccgcgttaccacctcggtttgcgccggcctcgcggcccggcgcctctgcgggtgcaaaccgtccgtttacaccgcgcgctgtaacgggcgcgcccggcgctttcgcgcggctcccggaatgtaattcagacagcgccattgccccgcgcctctcatcgtccggctgctttctgtggggataaagcgtcttactggtttccgatcaacgccgtattttgcgcggaacatccgcatgctccgctgttatgctgtcagtttaacagataaaatcgataaagtcaacacttttttccgccggtttcaaatatgtagttttcctcggcgaactgccagtcgacaatatgccaccatgcgtcgagataatcggcgcgcaggttcatatattttaaatagtatgcgtgctcccatacgtcgacgcacaggatggggcgaagcccgcgggtgagcggcgtatcctgattgggtgtggaaaagacgcgcaggccgccgtccggcgcgcacgcgagccatgcccacccggagccgaagcgcgcggccgcagtctgtgtgaaaacgtcgcggaagcggtcgaatgagcaaaagcatttgtcgatggcctgggcgagccggccgcagggatgcggggccgtttggttcggggtcatgcagtcgaaataaagctcatgtgtccagacgccgcaggcgttgcggtagacatcccgccggatattggggggcagctgcgcgcagccgcagatgagctgctccagtgaccagcagtggtaatcagggcagtccgcgagcgcctcgttgagctttttaacatagccggcctggtggcggtcatgatgaacctcgacggtcagcttgtcgatatacggttccagtgcgtcgcagggataagggagcggggtcagtttaaacgggtaatgttcgttcatacacgccatcctttaatggaaaatttgaaaccggggttcactgggatatatggatatagcgggaatcggcgtaaccgaccacgccgttgaagttgacgacataccagttttcccactggccgttgacgatgatcgagttgccgttgtaggcgtgcgccagcacgcgcgcgtcaagagagggtttttcgcggatgttgagatatccccagcggacggtgacaattccgcggcgcggcggctgcggcgaaacgaaggggatatcaaaatattcggtcagcgacaaaacgacgttttcggcgatttcgctgatgtgctgtttaatccaggtcgcgtcctcggggttgtcgtggtaggcgaattcgatgagcacgcccggcgcgcgtgtgcgggaaacctcgcccaggcgcgtggtggggacggttttgaccagccacggatagggatagatcgccttgaggttttcggcgatgatatcggcggcgcgtttgccggagacgcttgtggggtaataatagacctccgcgccctgacgcatcccggcctcgctttcgggggctgcgttggagtgaagcgccagatgcaggtcataattgccgcggttcgactgtgtgatcgacgaagctgcggtcatatccggagtgttgcgcgtccagcggatgccggacgaacgcaggtacggctccatcgcgtcggcgatcagattcatatagtattcttccgtgccgccgtttacgtagtgattccattcctgcgtggagggactgagataaataatcggcataaaaatcctcctgtctgtgcatgttgggctgttccaatgtatgccggcgggcaaaaaagcgtgcgcacaaaaaacagagaaattttttatggttttcgctttagtttttccggggcaatacgaacataaagaatagaagcgtatgacaaaaggtacaccttttgtcatacgcttccttttttgtctttggagcaaaaggggttgtgcttatttaggataatctggcaggaattatccctgtcagattatcctaaataagtgcatttctttttgtcaaaagacaaaaaaggaagcgtgtggcaaaaggtgtactttttgccacatctggatttttttcgttttgcgcataaggaggtgcggccatgctggttcttggcagaaatgtcggtgaatacgtggtgatcaacgagaatattttcgtgcgggttgtcaagcagaacggcgacctcaaacttgccatcgacgcgcccaaggatattaaaattgagcgcggcgagatttttgaaaagcgcagcgggcggcccgcaagtatggcgcggtaaaaacctgtatttccaagtttcgaatacaggcttcgggtatggttttctggttttcgcgcgtgctggcgcgctgtacacgcgggagcttgaaaatataatttttatgaatgagccgggcggagggatacgcccgcgacaattcagggaggttttatcatgggaatggtagttagaagcaacatcatggcagtcaatgcgcagcgtcagttgggcatgaacaactcgcaggtcggcaaggcgctggaaaagctgtcctccggttaccgcatcaaccgcgctggtgacgacgcgtccggtctggcgatctctgagaagatgaaagcccagatcaagggccttgacaccgcatcgctcaactcgcaggacggcatctcgctcgttcagacggctgaaggcgcgctgaccgaagtccacaacatgctcaaccgtatgaccgagctggcgacccgttcggccaacggtatcaacgaggattcgaaccgtgcttccctgcagaaggaagttgcgaagctgcaggaggaaatcgaccgcatttccaagagcacgaacttcaacaacctcaagctgctcgacggttcgcagtcgtatgcaggcaatgcggcgctgattggcgctgggacggcgaacggcgtccagaacctgtcggtcgagggcggcaacctggatgccgctgataccgtcgaggtcaacatcagcgccgacaagaccggtacggttactgttacagcgggcggcaaagctacaggcgtcaagttcacagtgacgcagaccggcaagggcttctactcggttacggccgacgtcagcggtgtgacagatgacaaaatcaaggcggcatggtccggtgtcaccgccaacttctccgtcgacgggcctaaggatgatggcacctatgcggctggcgcacagaagttcacagccggcaagaacgaatcgatgcagctccagatcggcgacacggccgacagcttcaaccagctcaaggtcggtattagcgatatgagctccaagggcctgggcatcgacaaggtcgacatctccaatcaggatggcgccgccaaggcgatcgacacgatcaagaacgcaatcgaccgcgtttccgcgcagcgcgcgacgctcggtgcgacgcagaaccgcctcgagtacaccatcaacaacctggacaccgcgtctgagaacctgcaggcggccaatagccgtatccgcgacacagacatggccaagatgatgatggagtacacgaagatgaacgtactgacgcagtccgcgcaggcgatgctcgcgcaggccaaccagcagccgcagagcgtgctccagttgctccagtaatgtgagcctggcaaattgatcaaaatagttttcacacaggcgggaaggacaccgccggaaaaatagcaaggaggtttcaccatgggaatggtagttagaagcaacattatggcagtcaatgcgcagcgtcagttgggcatgaacaactcacaggtcggcaaggcgctggagaaattgtcctccggttaccgcatcaaccgcgccggtgacgacgcgtccggtctggcgatctctgagaagatgaaagcccagatcaagggccttgacaccgcgtcgctcaactcgcaggacggcatctcgcttgtccagacggctgaaggcgcgctgaccgaagtccacaacatgctcaaccgtatgactgagctggcgacccgttcggccaacggcatcaacgaggattcgaaccgcgcttccctgcagaaggaagttgcgaagctgcaggaggaaatcgaccgcatttccaagagcacgaacttcaataacctcaagctgctcgatggctcgcagacgtatgcgaccgctacagccgccggtaaggccaacggcgtccagaacctgacgatcgagggcggcaacctgtccgcagcaggccagggcgtttcagttgcgctcagcgcacagggagcggtcaccgtcactgtaacgggcggcgccaacgtcgaatttaagacgacgcagaccggcaagggcttctactcgatcacagccgacctcagcaaggtgacagatgataaggtcaaagccgcctgggccggcgtcacccttaacttcagcgttgacgaggcgaaggatgacggcacatacgatacgacagcggcggcgatccaaaatgtcggcaagaacggatcgatgcagctccagatcggcgacacggccgacgatttcaaccagctcaaggtcggcatcggcgacatgagctccaagggcctgggcatcgacaaggtcgacatctccaatcaggatggcgccgccaaggcgatcgacacgatcaagaacgcgatcgaccgcgtctcttcgcagcgtgcttctctcggcgcgacgcagaaccgcctcgagtacaccatcaacaacttggacaccgcgtctgagaacctgcagtcggccaacagccgtatccgcgacacagacatggccaagatgatgatggagtacacaaagatgaacgtgctgacgcagtccgcgcaggcgatgctcgcgcaggccaaccagcagccgcagagcgtgctccagttgctccagtaatctgctgcattccggatagataaacatatacagtgatactagcgcgcaaggaaggcgggtggggctaccccacccgccttttttatatcatgggaaagaaggagagccggtgaaggccaaacgaacaggaatttttctgacaatcggtatgatcgtcaaaaatgaacaggaatacctgccccgctgcctggaggcgctgcgccccctgcgcgaggctttgccatgtgaactgattatcacggacaccggctccaccgacaggacgcttgaaatcgcggcgcagtacgcggacgaagtgcgccatttccagtggtgcgacgactatgcggcggcgcgtaatacaacgctggagaatatttccggggaatggtatatgtatctcgatgcggatgaaatcttcgacccggatatttccggcgtgatcgattttttcaagggcccgctctgtaaaaagtttcaggctgcggcgctgcggtttatcaactatgattcgcagaacaagccggccggctccttttatcccacacggattataaagcgtgcgccgggcctgcactttgagggtgcggtacatgagcatctggtcagcgatgtcaaagacgggtatgcgctccaaaccgtggtgcgccactatggttatatgggcgagcttgcgcgcgtgaagatgctgcgttatcgtcccatgatgctcgcagagcttgaaaaaaatccggatgatccgcgcatgctgcgccagcttgtcgacggctacgatccgcattatccggacgaggctgcacagcgcaaaaagctgttggagcggttgattgagatctgcctggcggataaaacggttaatcagcgttcttttgcctttctgtcgcttgtgcacacgcagtggacgcaatctgattttgaagggatccttgataccatcaggtggtatttcaaggagaagcttattaaaggggacagcgccgccgatatcgatatgtatgcgatgcgcgggttcgcgctgtttaatttaaagcagtttgcgcctgcgctggacgcgttggacgaatacagaaggctgtatcgcgcgttctatgagagaaagctcgacctgagcgatatgggtaccgtggggctgcatgggatcaatgatgaatatctgatgcggtcgctgtatgtcagcgcgcagtgctgccttgccctcaatgacaaagagcgtgcgaaaacgtatatcggtcaggtcgatatttcatccctggcggcggcttatccggatttgccgtttctggcagacgaatttggatatatgcgtgccagcggcgattttgcgcggatgggcgcgctttgcacacagattatggctgtgaacggcgaaagcgtgcggctgcggtttttccagctcgtggaaaaggagtttcctgtattcgacagtcagaagctggaagcggcccgcgcgctcgcagcggtgaagggagagcataaatttttgacacttcaccggatgcgcgcggcgctcgcggacggtgacagttcacaggcggctgcgctggcgcaggccttgctcgtgaaacaggatgccggtgcggacccctatttcgcggacgtcctttattgtgtgatgctctgcgggcagccgctcgcgcctgcgctggacgtgttcggcgccgctttggaggagacgctcaacgtcctggccgggcagcgtcccgattttgacacggcggtctgcgcggcgttcggacgggagccgttcccgcaaagcggcacgcccggggaactgttccgccgcacgcgcgttatgcttctggcgctcctgcgcggtacaggcgcggagcaggcgcgccgggatcagctcgccgatctttatacgcgcgagatcatttccttttgtgaacaggtttacaaccttgccgcgctcccggaacaggagcggtttatcctgccggcggagcatcgctttgcccttgggatgcgtgaggtgaacgccgttcttgggcaaggggacgcggcggcttgcctgcaaaagctccaggcacttttggatagctgtccgactatgcatcgcctgataaagcgccgcttggattccatcgcgcggcaaattcaggagaaatcggaggctgtcaatgaatttgagcggctggcgatgtctgtcaagcagcagttttacggctttttaaaagcagggcagcgcgacgcctgcgccgaggttttgaaggcatatgcggcggtcaatccggacgatcctgaaatcgatgtgatgcggcgcgattttgaacagtcgtttcgctgacagcgtgaaatagggaggaaacatgaaagttgttattttggcgggcggccttggaacgcgcatatcggaggaaagccacctgcgtccaaagccgatgattgaaatcggcggcgctccgattttgtggcatatcatgaaaatttattcgtattacggatacaatgattttatcatctgctgcggctataagggccatatgatcaaggaatatttcgccgattattacttgcatcggtccgatataacctttgatttttccgacaacaacaagcttgtcgtccacaacaatgtggcggagccgtggcgtgtgaccgtggtcgacacggggctgaacacacagacgggcggccgcgtaaagcgggttcaaaagtatatcggggacgagccgtttatgctcacctatggcgacggcgtcagcaatgttgatcttgacgcgcttgtccgcacgcaccagacgtccggtaaggcggtcacactgacggcgattcagccgggaggccggttcggcgtgctggatattgaggattcgaccggtacgatcacagcgttccgggagaaagcacgcgaggacggcggttggattaacgcgggattcatggtgctggaaccgaaggtgtttgaatacctggacggagacggctgcattttggagcgcgcgccgcttgaacaaatgagccatgacggacttgtcggcgtttataagcacggcggcttttggcagtgtatggacacgcagcgcgacaagcttttgctggaaagctattggcagaacggtaccgcgccctggaagctctggtaagggcgttctctggcggccggggattcaaaatgcgttaatagatagaccctatgcgggataaaggataataaaaggagatcgttatgattatacgtgccaaaacgaagatgctgttttccggaaagccgctgactgaaaagcagcaggccaacaccgatttgaatttgcgggaaattcaatcgggcgcgaccgaactgcgttccctgccgcggcggctcgtgtttgaactgacgaacgcctgcaatctcaactgcgtcatgtgcggccgcaattcggcgcactttaagccgacgatgttcgatatggagtggtttggctggtttgagtccatgcttgacaccgtcgaggaggtcacgctgatgggatggggtgagccgacggtgcatccgtcctttcagcagatgctggagatcatcaaccgccacagcgcgcgcaaatacttctgcacgaacggcatgctgctcgataagctgcacaacgcaatttttgacaaccaggtggacgtgttcgccgtcagcgtggacggtgcgcgcctcgagacgaacgaccgcatccggcgcggctcggatcttgtgaagatcaccagggatctcaaggcgattgaacagacgaaaaaggcaaacggccttgctttcccgtatatcaattttgtgttttgcgcgatggcgtccaatctgcacgagttgccggatttggtgcgcctggccgctgaaatcggcattgaggaggtcaaggtggtctatctcaccgtctttgacgacgcgctgcgcgccgacagcctgtgggaccgccaaagcgaggtgcgcgacgtattcgcgcaggccgagcagatcggaaacgagcttggcgttgtgctcaagctgccgcacatccagggtgaggacgaagcgggcgaccgcgcgcacaaggactgctttgtcgcctggcgcgatttcttcttaggctccgacggctacgtacgcccgtgtatgtccacgccggtcaagtttttcccgtttgacatgaagcgggatttcatggacatgtggaatgacgggagctaccgccgctaccgcgccggcgtcaatgccgccggaaaaatggacgcgccgtgcgcgcgctgttatcaatcgtcgcacgcgaactggaaccgccgcgaggcatttttgcagatgggggaacagttttcgcccaactggcagaaggactgagcattccggaggggaacgatttgaaggaaacggtattggttacaggcgcaaacggctttatcgggcgctatgtcgtcgggcttctggaatgcgattatacggtcgtcaaggtggaaacggatatctttgcgcttgactgggacgcttatctcagaaatatccgccctgattacctgattcatctcgcctgggtgacgggagaaggttatcaggacgcgccggaaaatgttttgtgggtgcagaaaagcatcgagctttaccgcgcgttttttgcgcagggaggcaggcgtgccgtttttgtcgggacagagcaggaataccggcgcagcgacgccccgcttgatgaaaacgcgccgctaaagccggattcgctttatgcggagtgcaaggcggacctcgggcgtattctgcttaaggacagcgccgtgcgcaaaaacggctttgtctggtgcaggttgtttttcgtttatggcggcggcgagaagccgcgcagactcatgccgtcgctgctgcgcggctttttaagcggggaacggcccgtctgctcctatgagggctatgtccgtgactatctttatgtcaaagatgcggcggctgcgctgcgcgcctgtctgttttccgattacataggggccgtcaatgttgcgggcggcgcgcgcacgaccatcggagagatcgcacggacggccgccgccgtgtgcggcggcgggcaggccgcgcacaagccgcttgaagcgtgcgggggacagccgatgtgcgtacaggcggacgtctcgcgcctgcgttccctcggctgggtcccgcgctatacgctggaggcgggcctgcgcgagcaggcgcatgagctgcgcgggcaggtgcggccatgacgccgcagttctggcgcggacggcgcgtgcttgttacagggcacacaggcttcaaaggaacctggctgtgcaagtggctcgatctgctgggagcgcgcgtcttgggattttccctgccgccggacggctacagcctgtatccgtcggccgggctttcacggcttcacgagagcgtgtacggcgatgtgtctgactggcaggcgtttcatgcagcgtaccgcgcctttgacccggaaattgtgttccatctggccgcccaggccatcgttggggaggctgcaaagcatccccgcgagacgtttttgtcgaacgcgatgggcgcggtcaatgtgcttgagtgcatgcgcgcgtccgatacggtgcgcgcggctgtgattgtcaccagcgataaggtttatgagaacaatgaaacgggcgaggcgtttttggaggatgcgcgccttggcggagatgagccgtatgcggccagcaagagctgccaggagcttgccgccggtgcataccggcgcatttacttcgcgccgcgcggcgtgggagtagcgactgcgcgggcaagcaacgtctactgcggcggcgacctgcattacgaccgtttgatcccgcatctgatccgtgcggcgcttgccggccagccggcgcagctgcgcagtccggacgcggtgcgcccgtggcagtatcttcccgatctgctgcggggatatctgatgctggccgaacgcctgtataaagaaccggcgcgctttagccaggcgtggaattttggaccgccttccggagagctttataccgtcggcgatatcgcgcgcatgatcggcggacaggcgcctctgccgggcgagcggcgcttttcggaggcgggccttttgcggatcgattcggaaaaaagccgccgcctgctcggctgggcgccgcgcacggcgctgccggagggtttgcggcgcacaatggcgttttaccgcagtttggacggcggcgcgtccgccggcgctttgatggccggggagcttgaataatggaatggagggaccaggattggatcagaaacaaattgacgcgtgcagggcgctttcaaagagcatccgccgcgatgtactcaaaatgacatgggagcgcaaagcggcgtttattgggacgtccttttcctgtgcggacattctgggcgttctttacggcggcttttatcatcaggacgacgatttgatgattatgagcaaagggcatggcgcgagcgcttggtacgcggcgctcgccgaggccggtgcgtttgaccgcgaacgtctgtttaaggagttcaatgtaagcggttttcatatgggggtgcaccccaagcggaacagcttgcccggtatccgcacatcaaccggctccctcggccatgggcttggcctggcggccggcgcggcgctggccaaaaaggcgaataaccgccccggccgcgcatatgtgattctgggggacggcgaatgcaacgagggttccgtatgggaaggctttctctttgcgcaccgctatggactcgataatctgacagcggtcatcgaccgcaaccgcctgcaatcatatgcgcacgacgacaaggtgcttgatatgggcgatatgaacgaaaagctgcttgccatgggctgggacagcgtttcggtggacgggcacgaccatgccgcgctctgggaggcgttcgcgcgcgctgcacgtggcaggccgatggcgattgtcgccaacaccgttaagggaaaaggcgtttccctgtttgaggacaaggtgctttggcattataaatggccggaggacgagcattacgagcaggcgctgaaggagttggaacaggcatgagaaacgcatttgtcaatacgctgatagattgtgctaggcaggaccctgcggtggcgctcttgatggcggaggtcgggttctccgtcgtggagccgtttgagaaggaattcccctcgcgtttttataatacgggcatcgcggaacaaaaccttgtgctgacggctgcgggcatggcgctggaggggatgcgcccggtggcctattcgatgtcagcctttctggcgtcgcgcgcgttcgagctgatcaaggtcagcgtgtgctatcaggatttgccggtcgtgctggccagcattgggaccgggctttcctacagcgagcttggcgcgacgcatcatgcgaccgaggaaagcgccctgatgcgcgtgttgccgaatttgaacgtgtttttcccggcggatggggcggagctttccgaggcgctgcggttcgcgctgcgcgcggagcacccgagctatatcagtttcccgaaactgccggacaagccgctgccagcgcatccgttcgagatggggaaggcagtccgttaccgggacggcggcgacggcgccgtgcttgcaatcgggcacagcgttgtggaggcgctcgcggccgcgcaggcgcttgaacagcaggggatccggctttcagtttatggatttcataccgtcaagccgtttgaccgcagcgcggtgcttgaggcgtgcgcgacgggcagtttgtttgttgttgacgagcatcagcagtgcgcgggtattgcgggcgaggcggcaaaggctgttctggaaggcggaaagatgctgcgccatttctgtgattattccattcccgactgtttctcagatcacgtggcgcgttatgcacaaatgcaggaggaatacggcctgtcagccgcgcgccttgcacaacgcatcggtgaaacgctcggaggcgggcgatgaagcgggtgcttgtcaccggtgcgagcggccttttgggacgcgcgctgctgccgcgtctgcttgacgcgggatatgaggtgcacgccgtcacaacggatgcggcgcgtcttgccttcgcgcccggcgcgcaggcgcagacggccgacctgcgtgacggcgctgtctgccgcgcagttgtggaacgtgtgcgccccgaagcccttgtgcatctcgcatgggatcagaaggatgccggttttcgcaacgcgccggcaaacctggactggctctctgtcagcgtcaatctgctgcgggccttttatgactgcggcggaaaacggtttttattcgccggtacaagctcggaatacgacggccgcagcgggcgtatggaggagacggccgccgcgcggcccgtttccatgtatggacagtgtaagcgcgcgttttccgagacgcttcagacattcgccggacaatatggcgtcagcgcggtgacagcgcgctatttcacaatctacggggagcacgacggacatgccttcggcgcgatcccggcggccaccgcagattttctggcggggcggccggtcgcctgccgcgcgccgaacacgctgcgcgattatatctatgtcggcgacgcggcggccgcgacgctggagcttctggaaagcgaactctgcggcgcggtcaatgtcgcctccggcgtgccgcgctccatgcgcgcggtgtttaccgcgcttgcccgcgccgcggacgcgctgccgctgctctccttcgaaaatgaggatcagcccggcgatattcttgtcgcggatacgggcaggctcaaccgggagcttggctttacctgccgtatgaactttgaggaagggctgcggcgcacggtggcctggcgcagaaaacaggggggacattcttgaagtatgatctgatcgtcgcgggctgcggcttttccggcgctgtgatcgcccatctggcggctaaacgcggagacagggtgcttttggtggaaaaacgcggccacatcgccggcaatatgtacgactatgtggatgaggcgggtatcctggtccagaagtacggaccgcattccctgcatacgaaccatgcgcgcgtgcgcgcgtttttgtccggcctgtgggagtgggagccgtttatcctgcgtgcacgcgcgatgatccgcggccgggcaacgccgtcccccttcaacctgaaaacgatcgacgattattatgcgcccgacagggccggacagcttaaggagcgtctaaaggccgtttacggcgatgcgaaaaagacgacgattgtcgagctgctcgaatcgcccgacccggttatccgggagtatgcacagtttttgtttgaggaggactaccggccgtatacagccaagcagtggggaatcgcgccggagacgcttgatgtaagcgttttaaaacgcgtgccggtgcggctcgactacacggacgcgtatttcgacgacgattggcaggtgctcccgaaaaaaagctttaccgctttttttgagcgtctgctcgatctgccgggaattgaactgcgccttaggacaaacatactcgatcacctctcgcttgacagcgaatcgggaacgctttcctttgacggtcagacagcgggcgtccctgtcgtatatacaggcccgcttgacgagctgttcggctgctgctatggcagcctgccgtaccgttcgctgcggtttgagtggaaaacgctggagatggacagctttcaggaaacgcccggcgtcgcccatccaaaggctgagggctttacgcgcatcacggaatatacaaagcagccgccgcaggacgggcatggacgcacaacgatcgcggtggagtatcccgcgccctatcagccgggcggggaggcgtactatccgatcctgactgagcagtcgcagcggctggcggcgcgttaccgcacacttgcgcagcggtttccgcatctttatttgtgcggacggttggccgattttaaatactacaatatggatgaagcggttttgcgcgcgctggaattgtttgaaacgctttgagggtagatgggggaaagaatggataagccaaaggtaacgtttttaatgctggcctacaataaggaaaatgaggtggaacgcgcgatcaaaagcgtgttggggcagacggagcaaaatgtcgcgctgtttatccgtgacaacggttccaccgaccgcacgcgcgatatctgccgggaatacgccgaaaaggacgcgcgtgtgcgccttgtgcgcaacgaggtcaattgccggaaggatggcggcggctcattcaacgatggctgtgtcacgcgctattggacgccgctgcctgacgatatagttggcgaatacgtctccatcattgattcagacgattatttggaaccggattttgtcgagaagctctatgccgctgcgaagaccataaaggcggaaattgcggtcagcggcagttcattttttgatgaaaaaggcgtggtgttcaataagcggctgccgccgccggtatgtacgcgccgcctttcgcgcgacagcgaggtgtttcgttcgaacctgccggcaatgtataatacgtttcgtacctggtggggcaagttgttccggacagatttcttcatgaagtattatgacgaagcttggagcaccatatcaggcagcgaatattggtggggcgcgtttgatacgctgattatgctgcgttacctggtacactgtgaatccattgtcagtgtggagcagccgctttataatttttttctgctgcgctcctccacctatgccaatcgttccgtcgaatgggtacgatcgctggaggcggaggcactctaccatgcgagcaaccgcctgcttgatcatttccatgcgcatacgcgcgaaaatgatctgtttttgctgtctcttaactggggatatctttatgaggcgcttaaggcggcgcagggatatatcaaatggcccggcgtcacgccatgcaggctgctggctgggattgccagtgttctcaactgtccgattctcagttattatatccgcggcaatgagccgatgatctgggaggccttgcagacacagattgaaaaggcatgtcaggccaggccgggcgatctgttggtgtttacatcctatctggcgcgcctgctttatctggaaaagctgcttggcagcgacccggccagcgtgcttgctccgccgctcctcattagctgcctgttcgatgcggaaaacggaaatcaccttggccttctatttgtaaaaatggtgaagcaccgtactaccggttggtatactttcacacagccgggtgctccggatatcatccagcagaggcgtcttggcgaccacacaatatggatgcagccgcggattgacgcctgtatatgggacgatacacaggaggtcaaggcgttggagccgcagttgacggcgtgtatggactcggaggattatgaacaggcgtgttcgcttttggaggagctttcacacaaaagcccatttaacaggaccgccatgttttgcagaattcagttggctgtgctgacagaggatgcggagcttgcctgcgtgctggcctgcacagcaaaggttttatggccgcttgacccgcagatgcagcagctctgctggggcgtgctcgatatgtatacgcagggcttgccggcggaataagggaggcgcgaataatgcgtataaataatacggaggtcacgtctctggtgagcgtgattgtccctatttataatcaggaacggtatttggaacaatgcgtggattcgctgctgcatcagacatatccgtatcttgaaattattttggtgaataatggaagcaaggaccgcagcggcgccatctgcaaaaagtttgcgcagcaggaccggcgtgttcgtatgctggaaatcaaaaaaaatatttcagccggaaacggccgcaacatggggctcgacgcggcggcaggggaatacatatcctttatagacagcgacgattgggtaaagccggaattcattgaaaagctgttgcgcgcgcttttggaaaacgacgtcccaatcgcgcagtgctgttatgagcgggctttttggaacaacacattttcggacacgcttccttatcatcagttccgtatccttagcggccgggaaatgtgcaagatcatgaatgaattcatcggtatgtgcggaccgatgacaatgatgtggaataaactttaccgcgcagagctgtttaaagacttccgtttttatgaagacgtggcctatgaggatatgtacagcgtttacaagctgttgtatccgctggagcgtgtggcgtttattccggacaggctcgcctattggcggcagcacgggtcaagcggaacatcccggtattcatacaaggatttctgcatccatgaaatgtatgcgtacgaggaacgcgtccgtttttttggaatgcataatgacagggagctttaccgtctggcgctcaagcgaatgtattatatcgctacacagcatttatatttgcagaaaagatatgtgaaggattccagaaatgtacaggattggctgctcgataaaatcgcggatatttaccgtgagctgatggcgatggatggatggtccgcgcggacgcgcagcagaatgcggtttatccgccgttttcctgagcaatttggatactggagcctgcatcataaggtcgatttccgcatttaaagagattgctttcaggagaggtagatcatgtccaatttttatacacatcttggcgtgctggatcaaacctggctcgattgccgcgagatcgtggtgtatgggctgggcgttatggctctgaaaagtatggagtcgctcaggcgtgattttgaaatcccgtttatcattgacaacgaccccaaaaaggcggggacccattatgcgggaatcccgattctgacacttgagcaggcgcgcgaaaaattgcccggcaaaaaaatagtgatcgcctcgacatatggcgtcagccgcgcgattgcaaaaacgctggatgcaattggatttcgggaaacattggattactgcgcgctggatctattcgccgcggaatggtattggcacaaccggcgcgaggtacaccttgtcgaggtgcacacgacgattacggagcagtgcacgtttaactgcaaaaactgcaacatgtttatgccgtatttcgaaagtccgcgccatttgcctgtgcgcgagctgacggacgatttcgatctgtttttcgcacgggtcgactgggtatcgggctttggcctgctcggcggcgaaccgttcctgcatcctgagctttatgaaatcctgacgcatctgtgcggcagatatgccggccgcatcggtgagatcagcatcataacaaacggtacaatcgtaccggatcagcggcttttggagctgatggcgcgccataatgtacgcgtccatatcagcgattattccaaggcagtgccgtatgccgaaaaacaggcgcaggtggttcgcgcactcatggacagcggcgtcgattaccgcgtcaatgaatcgctggtatggaccgattttggctttcccgaccatccctggcgtctctcaaaggaacaggccgccgcacatatgcagagctgcgcgcctgttttccgcggactaaacagcgggcggctttatttctgccatgtggtgtgggccgctcagcgatgcggtttgtatgaaccggccggggcggacagcctttgcctggcggcaatcgatccgtccagtgatgccgaccggcgcgctttgctggagtacagccttggcagcatggcgggcggcagtctatccttctgtaaattttgcggtggctgtggaagcgacaaccgcaatttcgtgcagccggccatccaggcgccgcgcggcgttcaaatgcacatcaaggaggccgggcggtgaatattgacgaacgcatcgatcaggtcaaggacatttattttcaaaagctgctgcgccaatttcgcacagcgtttctggagcatcgtaacagccgaattgtgctgtacagcctaggagccttttcggcgacagttgttgaagtcctgcgggattttcatttcgtggggctgatggaccgcgacccggaaaatgtgggcaagaatttctttggcctgccggtgttcagccccgagcaggcggagcagcaggctgatttgattgtgatcaatacagaggaaagctattggcagaccatctaccggcggatcgcgcacctaaatataccggtctattaccgaaatggtacgcgcgcacagctggaacaacggcccaatacggattgtgcctactggtcgcgcagcggggaggagcttgccaaactgatcgatcaatacgaggttatttcgttcgatatctttgatacgctcctgatgcgccgggtgttggagccgcaggacgtatttcgtttagtggaatatacgctgcgtatagattttggacttgagctgccgtttaccaagctgcgcctccaggcgcttcatgaagcggggcagacggcggaacttgacgatatctaccttgcgttcagacggatcagcggactgggagcggctcaggtcgagcggatcaaattgaaggaattggaaattgagcggcgcgtgctgatcccgcgccggcctgtggccgctcttttccggcgtgccgccgcagccggaaaagaaatctttgtgttaagcgatatgtatctgccgggcggttttgtccgggagaggctggctgaatgcggcatcacaggcgattatacgctttggatttccgccgaacaaaaggcggaaaaacgtgacggaagcatgtgggcggcttacgcaaaagcgattcgcggaaaaaaggcgctgcatatcggcgacgatcccgtctgcgacgaggagaaaccgcgtgccgccgggattgatacatatcgaattttcagcgccgcggccatgctcaagcacagttcgcttcaggatttgtttgcacatgtattgacgctcaacgacgcgttgatcgccggcctaattgctgcgcgcctgtttgaggacccgtttgcgctgcacggttccaaaggacgcgtatgttttcatcgctttgaggatttgggatacagcgcatatggatgcgtgctgtatacgtttcttgtctggctgcttggacaaatctgcggcaaggggtttgacatgctgctgttcttcgcgcgggacggctattttatggccggattgtatgagctgctggccaagcgcctttcctgcgggcaggcgcccaacggaatctattttatgatttcacgccgcttggccgcaatcgcagcgatcgaaaatgaggaggacctcctggaggtggtgcgccttccctataatgggacgttcgcacagtatatgcacgtgcggtttggcatcgaggtgcctgcctccgatcaaaatcgggagcgggttgtcaatcccggttcagatttcgaagcattgtggtcctgcctgacgccgtatatggaccgtctgcgcgcacagattcggatggagcgggccaattaccgcgcatactgccggcggatgttggacgggaaaaagtttgcgatcgttgacacctggtacaatggaagctgccaatattatttgagcaagcttttagacagatcgatgaccggttattattttcttgcggatccgtcacaggagaacagaaacgccagccgcggcgggatgatttcctgttttgcagacctgccgggcggatgcggcatcaatcggagaagccttcagtttgagagtgtctataccgctccgcacggcatggtaaaatcatgcgatgaaaacggagccttttcctttgaatcgccaggcggcaaccaggcgcgttttacagacaaagagcgcatcaataacggcgtgcggatgttcatggaggatatgctctcccttttgggctgcgaacggcttgaggacgctttgctgtcctgcgcgtgttccgactggatttatgaatccattttttcgggcagctgtgatttttcccaggaaatacggtccagctatgtcaatgaaaatgttcttacaaactccactgaattcccgattatggattaggaagatggctggaaagcaggaaagcctatatttaagcaaatcgattttttgcataatgcaaaaaacgcacggcgcatttgcgccgtgcgttggaattctttgagagggaattttaacgggaagaatcgaaagggagaaaagaaaatgaatatgaatatcctgacagcctcaagcgaaaagttttttaaatatatgatggttatgttgacttccttattccattcaaatgcaggggacacgttcgatctttattttatgcacaaaggcctttcagaagacatgatccaatccctggagtcgctgacggacgcccataatagccggctgcattccataattgtggacgcggatctgtttgccggttttcctacccgcatggtcgggccggtggaagcgtatttcaggttgtccatgatggaatatcttccgcatgacctggagcgtattctatatctcgattcggatatgattgtcgataaaccgatccgaaaattttacgaagcggattttgaaggaaacagcctggtagcatgcgtggattttggtattaattatttgatggaaccatttacagttaaacatggtgtctcccgcgattatccatattttaattccggcgtaatgttgctgaacatggggaaattcagagaattgggaatagggatgccctactttcgaagggttttggagaatttgacatctgatcttgtcctgggtgatcaggatctgttaaacatcgtctttcatgataaagtgaaactcctcgattttgcaaagtttaatttccagccgttggatttaatacataataaaccctataaggtcgatccacagacgagcgatgatccggagtttgcatcaatcgtgcattacacaggatacaagccctgggatcaatggatcgtcaacccaggttcggaaatggacgagctttggtggcgttacgcgcgtatgacgccagcgtgtaagcagatggaatctgattttaaacagtcggtgtttaaacggatgactttgtaccagcagtattttttttctgtgtcgaaatatctcgctaatcgcgtgaaagggaaaagcttcggagcgtttttgtgcgaaaaagggtatcggacaatcgcgctttatggaagcaactattttgccgagattctgtatacggatttggccggaagcggcgtcagcatatcctatattatggatacttatgacagaagaaaattttgtggtatgcgggtgcatgcgccgtcagaattgaaaacgctcgatccggtcgatgcaatcatcgtaacggcatttttttattacggggaaatagctgctgggctggatacggagatccctgttgtttctctggaaaaacttatcgaccagttggacagggaagaaaactgatctcctgttcatttgccggatgatatgatgatatatggaattgtcttgcaattttcatgttcatggtctataataaaatcaagttgggagggatcatgatggatatcaacgcgatcagcgcggcgagcatcgtttaccatatgagtcaggtgcagcagggcgtcgcagttgcgctcttaagcgatgcgatgcagatgacggaactcagcggcgcgcagatgattcagtcgatggagtccgcaatgccgccgtcagaccacttgctcgatacatatgcctgaataaaaaaggagccggttttaaccggctccttttttattcatcttttaaagcgtgctgcatacccgcttccttcacaaattctgcaaatttcaaatcgtcctccaaaagatgttccaaaatccacgtctgcaaatatttgtggaagtcgtccatcttttccggagcgaagcgggaagcttcaagcgcagtgctgtgaaatttcagctgcgtgcccagatagttatgcttggcctgatgatcgcgataaagcggataatcgtaccgcacctggaacgcctcctccgcctggaaatggtagagggtgtaatggttcaaaaaatcgagacattcactgaccttttggatatcatcacggcatttataactgatgaaaaaagcattgatcgccttgatcaactcccggtgctgacggtcaagcagctcgatccccaattcgagctttggctcccaagaaaaaatgaccataagtccgcccccttcgttaccattgtagacgaatgggggcggtttgtaaatggaaatttacacaaagacttgtaaaattatttcagaaaaagaagctcttaatcaatcatcaaaaccgagcatctctagtgtatcctctaaaatatcagcgcgcctgtcggcttcgtcggcctcccgttccaagactgccatctggctgacaaattcttcacggttgatctgacccgaacggtactgttccataagcatatttccttccagatcggcggcgtcttcggcgaccttcgcttcgtgatactgattaaacagttcgtttatatccgcgtttgcaagatcaggcattgtatatgggatcatcatttcagcctgatgctcaagcatttcctcattaaactccagttccgccctttttgtcaacagagctgccttttgctcctgaaaagcagcggattcaattttgccgattcggaaatcagcgtccagaattgcaaggtcgacagacagcgcgctgacttcagccttggtatcataatattgctttaggatatcctccagttccgcggaggacgccggagtgcttgccatacccggcgctgtacctgactgggaggaggatgcagcggcgccgctggaagctgtattcaggccgttgtccgtgacgataggctgtgtcatctgggatgtggttgcgacgccctgtgcaggctgcgacgaagcacatgcggacaaaccggcacaaaggcagagtataagagcaaaagaaatttttttcataatgaatcgtcctcctgtttaaaaaatagatattccgtttggagcaaaaatcatttgatgggcttactttacaggtcaattatgaaagaaacattaaaatggaaaaagtaatgcatatatgttgctttcatttgattttaatgatattctcataaaataagcagaaaaagaaaagggggaatgccggatgagaattttagttgcggatgatgaacgggagctgctggatatcacagtcaaacggctcaaagcacaaggatacgcggtggacggctgtgacaacggcgatgacgccgcttactatttagagcagacaccatacgatctggcgattctcgacattatgatgcctggacgcgatggactttcgatcctgcgcggactgcgggcggccggcagaacgttgcctgttctgctgctgacggcgctcgatgcagtcggagatcgagtgtcagggcttgatgcgggggctgatgattatctgacgaaaccatttgcatttgacgagctgcttgcacgcattcgcgtgctgctgaggcgcagctcgtcggataaagcagttgtgctgacggcggaagatctgaccatggagctttcaacccgcacggtccgccgcgcgggccaggagattacgctttcttccaaggagtatgcaattttagaatatctgctgcgcaacaagggcgtggtgctctctcgtgcacaattggaaagccatgtttgggactacgattttgagggcggaagcaatattgttgatgtttatgtgcgttatctgcggcgaaagatcgatgatccatttgaaaagaaactgattcagacggtgcgcggcgtcggatatacgatccgccagacgccatgaaacgcatatcgatccgggcgcgcgtaacactgtggtacacagggctgcttgtggtgctgttggggctgggcgttgtctatctgctgtccttttccgatcaaatgcttttgcgccagacgcgcgacgcgctgctcgatgttgtatccgacgccgttaagcaggcgcattttgacgatggagagcttgacgacgagaaaattgacttttacagcgaaggcgtgtccgttttcttctacgatacaagtggccgcctgcttgctccacgtgtcaaccgcggacttcaagtcgattcgattctggaggatcaggcagtcaagacagtcagtaacggccgtgaaacatggatggtgcacgatctctttgcgattcaggatggaacaggcttttgggtacggggcgtcgtttcattgtctggctccacagccacagtgcacgggatgattttgcttgcgctgatcggcgtgccgatttttattgcagttgcggcgctcggcggatggttgatcaccagacgcgcgtttttcccggtcggcaaaatggccgagactgctcaggctatttcctccggaagcgatctttcactgcgtgtgccggatgatggatccggcgatgagctttcacggcttggatgtacaatcaattccatgcttgcgcgccttcaggcgtcgtttgaaacagaaagacagttttcgtccgacgcgtcgcatgagctgcgcacaccgacagccgtaatcatttctcaatgtgaatatgcgctgtctgacgctgtggacgaggcggagcgcagggagagtcttggcgtcgtcctgcggcaggcacggcggatgtccgcgattatctcacagctgctgctgcttgcgcgcgctgaaaacggaaagtttgaaccaagttgggagcggctgaatttaagcgaattgtgtgaaatggttttgctcgagatggaggatacggcgcagtcccagggcattgcgctggaaatgcagttagagcctgacattatgctgacgggagatcaaacgcttctgatgcgtctgctgacaaatctgataaccaacgcaatccgttataaccgcaaaggcggacgtgtcgaggtgtgcctgcggcgcatggaaaccggtgctgttctgcgtgtagcggacacaggcgtcggaatccgcgaggaggatctgccaaagatatggagccgctttttcagggcggatgcttcccgcagcagtaccggaacaggactggggctgtctatggcgcgttggattgcgcaggtgcatggcggtacgatcactgtggaaagcgtttatggacagggcagcgttttcacagttacaataccatttgaacaaaaagataaacttctttaatcatgttttaatttttcatttgtatgataaaaccatcgaagggagcaaatccctgaagaaaagaattgaaagcaggaaaatagagaggtgttcgatatgacaacaaagaaattgaccgcagctatattaagcgtggcggccgtaatgtccattgtttcaatccaggcgtttgccgccgctctgacggcgcagcaggccaaagcaattgctgaaaagctcgtgccgtcaggcagcgcgtatgtgacgacagaggtcgatgacggccggtatgaggtgaaattttataatcaggcaaagcttgaaaagtatgaaatcgacgtcagccgcgccacgcagaaggcgatttcatttgacagcgagctgctcgacgaccgcggcgcacgcacagccacgttgacgcaggagcaggccaaaaaggtcgtgaccgatgagcatccaggcgcaacaattcagtccgttacggttgattatgacgatggactgatggaatatgacgtccgtttcactgccagcggttattacggcgagatcaccgtgcatccggggaccggagcggttcttaaacgcgacattcagattggcacgcagccgaccgccaacgatgttcgtactctgatcagctacacgcaggcgacggaagcggcgctcaagcaagtgccgggcggcgttataacggacgttgacctggaccgtgagggcgggacatacatctatgagattgaagtttataaggacgggttggaatatgatgttgccttgaatgctgcggatggcacagtgctgtggagcaattcccatgccgacagttggagcagcttcctgcgggcaaatcccgcttcgacgccggcagcttcttcaaatgcttcggctgcggcgtcatcgcgctcctcaacaccggcagcaaccccgtctatgccgagcggtaataacggttatatcggttttgagaaagcaaagcagatcgctatggcccaagcgcccggcgcggttgtacgtaaatgtgagatggattttgacgacggccgtatgaagtatgaggtcgagctacgcaacggtttctgggagtatgattttgatatcgatgctgtgactggtgcgatcattaaatgggatcaggattatgacgactaaatagatttatagcggcgagaaatattaaaacgggccgtgctgtgaaagctctttccacagcacggcccgtatgttgttttgtcagcctttctggaagtggagcgcctctctggctgtggcgcacagatagcgcatcgcctgcacgggatatgcgccgacagccgtttcgccggtcagcatcaatgaggaagcgccgtcgagcacggcgttaaagatgtcgcatacctccgcacgcgtcggtacagccgcttgctgcatcgaatggagaagctgtgtgacgaccataaacggtttgccggctgcgcggcaaattgcggccgcgcgcttttgcgccgcgggcagttcccacaggggcatatcgtttccaagatcgccgcgtgcgacgacgatatgatcggcatatgggagcagacgcgatagagcggaaagcccggctttgttttcgagctttgcaaagacggcgatttgaggagcgccagcgtcgagcaatgcgcgccgcagcgtcagaaggtcgtgctcatcgcgcacgaatggaagcatgacgcctgtaacgccgtatgcgtttgcgcgggagaggttttcaagatcactctgcgtcagggtgggcggacgcagcgccgcgcccggcagcgcgatgcttttgcgcggatgcagaatgccgccgcgcaaaaccgtgcagaggacgcggccatcgccgggcgtatcgacgcgcagcaaaagcgcgccgtcgtcaagcagaatttcctgaccggcgcgcagagctgagaaaataagcggcgggaccgggatggcgccggtatccatggcctcgtcatcggccgtgagtatggcgcatgttccttccatgagcggcagcggagcgggcagttccccgacgcgcagctccgggccgcgcaggtcgatcagcagctgcggtgaaaggcgcgcgcgggcggcggcttcatgcaggtttgcgagccacgcgccgcagtcggcgaggttggtgtgcgagaggttgaggcgcatgcccgtcatgccggctgaaaacaggtctgatagcgtgtctgtgccgcagcaggctgggccgagcgtaccgtaaaaatcgagcgcagtcataacagatggtcctttctgtccattaccaggagcggttttcctccgggagaaacgaataaataggaggcgtggtgttcagttcgcatggcgcgggctgtccatatgcatcaatgaaagcctgccgttgccggtcgatagtcttttgcagagcaccggcatcggggcgcgccggcagatcgatttgatgcggggctggggcgggcgcatagctttcggaacaggcggggacgttcccgatcgtttgcaggagcgtttcggattgttctggtgtgagcgcgccactccaataggccgctaaattttccccccatcggtggtcggcaagcatatagctgtcatccttgagaaaataacggtaggtcaaaaggccgtcccggatcacattttgttcaagctgcgggtccagatggtaccatacgccatcgagctgtacaaccgtccaggcatggtcgatgaaacgtccgtcgacggaaagggtcagaccggaaacatatgcggcctgatatcccatgcggttgagcagcacggtcaaggctgccgcaaaatcctcacaggaaccgacgccatagcaaagcgggctgaccgcacggctttccacataaggcggcgcaggcgtgccgggcacgctgtgccaccgccaggaatccagccccacagggtccgcgaaataggtattttcgatgatgtggcaataggcggctcgaatttcctccacaggttcaccgcacggcagaccggcagcgatttcgtcggcgcgcgcggcaatgtaggcgttttccagcgggagcgcgcctttttgcgcagcaatggcagcaggctccgaagcggcggccgtgaccggcgcggatgcggcggaggacaccggtggcattgaaagaacaggcgcggcttttccggcccctgtgcagccggcaaaacagatcaataagcatccaattgttaaaaaaattttcacaattatgcatgattccttccgcatttttacacttcaattatataggaagggggcgggaaaagcaattgcttttgtttgtgacaggacgcgccgcagccgtcaggctgctgcctgtgctgttcgcggcgcttatactgagctgctgtgccactcccgcgcggcggcctgctccggctgcgccgcgtccggacgttttttctgcggcgccggcgcgttcccaggatgcggccggtccgcaaagcggtttgtttttctatggacgcagctgcctgaaagacgaggagctggcgttgtatgatcttttggatgacgctctgcgcggatggaatacgggaaaacgtctggaactgcctgtgcccttggatgcgcagactctgaaacgtgtatggaacagcgtgctgtatgaccatcccgtttacgattgggcgcgctgtgtttacccggatacggacggactcattacctgctgcatcctggaaccgcgcgccggtttgactgtcgaggcggccaggacgcgcagccgggagatagagcgcgccgccgatcaattgctggagggaattggcgggtcggattttgaaatcgccgttgcggtacatgacgcgctgctgcaacgaattacttatgaacaaggggtgcaggacgcggacgccggttcggtttacggtggccttgtacgcgggcgcggcgtatgcgacgcctacagccggtcgtaccagtatttgttgcaacggatggggatcgcctgctgctatatcaccggtatgagcggacgggggattgcgcattcctggaatgccgttctgctggaggatggatggtattatgtggatattacctgggatgacgtgcccgatgagaagggatatttgtttcacgactatctgctggtgcgcccggaggagcttgcgtccgaccatttcccggacacggagccatacggtaaattgccgccggcgggtacagggcagttcaattattatatacaaaacggtttttttgtgaacgcacaggccggacaggaccctgtgccgtctattgcaagggcgttttcggatcagctgtcaacgcgggagctgacggacgaaaagcgtccggtctttctggagatcagggtggacggagatccagaacagtatacgcgttggcgtgacgcattcaatgaacatctgttcgatatcctgagggaaatgcagcgcctcgcatcggaaggcggcttgctgtttgaaattgaaacgactgggtcggtcacatatcactttaatgacagcacacgggtattgacgctgtttccaaaggcgtcgctgcccacacaggagagtgtagggaaaggggcatagccatgagtgagcaggagaaagcaagagaaaagcaggtcccggaggaggaaaacacacacgcaggacaggaaacgccgcaggaaacagcgtccgtgccaaaagacgccaaaccggagcagccggtcgcaaattcaggcggggatgccggtgctgtgcggccgtcgggcgggaaaaagttccgctggcagaagcggtattcggcgctgctggccgcggcgctgtttgttgtgatcggcgttgcggcgctgatacggcaaagcgcgccggccgagccggccggcgcgcctgcttcaagcatggcgccgtcctccgcgcagccgggcgatgactttgaatatccagagaacgaggcgattgatgcggctgttttctcgtcaattcatctgcttgacgagggctttgtcgagatcgtaccgcagtcatggtttgggaataacaacgacgacatccccctgacgcttgaatatctgcaaaactgcctggagctttcgccttcgcatccattcactgtgacggaggagcaggggacgtttcgcgtttatattgagggcatggagaaaaacagttgggtcgatttgatcctgccgtacagggatggcggggaggaggacgcgcgccggtatacggccaacacaggactgtgcggatggcttgatctgaagtccggatacggcggcgcggcgatcgacgcgccggtccgtgtggaattcaatgctccggtatctccggagtccgcgcgcggccgcgtgctcctgcggcagggcgaggccggtcccgatcagattgcgccggccataccgtgcgatgtgtcgtatgaggagcgcgccgtactgcttacgccgcatgagatgctcgactatggcgcatattatacagttgagctggccagtacgcttgtatcggtggacggcgcgcggatgggaaagctggacagtctgccgttttcaaccgagcagcgcgcattttccatttcagttgtggacggcaatacaaacttattccggccgggcgcggatatcgagctgacatttgaggtgaaaacggaatggagccagggcgtcgacgccaaaaccgagctgttcaggctgacgggagtcgaggcgtatcaggcggtattgacaggcgcggacacacagcctgacgaggccggggataccgggacggtacatctggacgacggctttgcatccgtgacctatgacaatcccggcgtgggatactatctgttccgatgctcggtgatggaccagaaaaccggcgaaccggtggtgatcgagaaaccgtttatggtttccacaacggccgtctatttgcaggctgccggtgaaagcgatttgatctggcttaacgactgcgcatccggcgaggcgctcggcggttataccgttgtattcacgcaggcaggcgaacaggtcgcgcgcttcgtgacagaagcggacgggacggctctgttcagccatacggtcgttgcaaaaacgccaacctggggaggactggacgctgacagcgactgcatcttcacaatttatgacccggatggaaaagcggtttacaccgaccggaccgcgtgtcttggatgggacagccagaccgaggaaaggtattattcatttttctacctcgaccgcgcgctgtaccggccgacggatacggtgaatttctggggctatgtcaagccgtaccgtatgaaccggggcgctatgcccacccaggtggaggtggtatttgacgaaggcggccttgacgaacgcgtgacggtttcgctgaacgcggacgggacgttttccggttcgctctcatatgaacaggtggccagctcgcagtatggcatatcggcccgtatgctcctgccgccgccatacctggaggatagcagcggcaatccggttacgacgcatcatatcgataccatatgggtcgacattaaggattttgtgacgccagcgtatacgatttcatcgtcggtcgacaagccgatttaccgttcgggcgatactgtttcaatcaccatcacacccacgttttatgacggtacgccgctgccggattatccgatcgaattcagcgtgtttaaccccacgagcggcaattttgaggcgattcagaagctgacgaccgacgaaaagggcgttgcatatgcggcgatcaaggccggcgagaatatgacggcctattcctggaggccgacttatggctattattacatcaagatcgcaaatgacggcgaaaccgtttcccaccagggaagctacatttacacgccgggcaatgtgattctgcgcccggaggttacgtttgacgcgcatggagcgcggctgcaggtgcttgccaacagcgtcacgctcgaaggcgtcagggacgccgaacaggcgcagcggttggccgatgcatatgatgatgacgcttacgacgttctgatcggcgatccggtcgacatgcagttgtccgtggagacggatttgcgctactttatgccgcgtgagcagggggaggatgatacgtccgaccggcacatatgggacgaagaaaacatcgtcgccgtcgaggtgaaggacggcgctggcacggcagagctgctcgccgccggcgcgttcgacccgtcagaatatgggtgggtttccgtcacagcatcgtatgtgcatgacggtaatacgctctcaagcagcgccagcgcctcctacagcggcggtcgtcggcgtgcttatagaggaacggatgaaaccgcgccgaagggatatacgttcaatgtttaccgcggcgacgagccggagccggtccagacgtatgaggaatatcttggacgcagctttgttgagacggatgtgggcgtgccgctccagttcgagctgctgcgcgacggcgtcccggtacagggcggccgtatgatctatacgcttgtgcaggacgatatcatcgggcgcggcagcgcggacacggcgcttacgctgacgccggaccaaaaacacgcgaacagtgtcctgctcgtggcggcatattttgacggacacgatgtatacgcggtcgccaactgttatatccgcatcaaccaggagagccttgcgctggagattgaaacggcgcttgacaaagaaacgtatatgcccggcgacacggtgacgctgtcagcgaaggtgcgcgacaaaaacggcaatccggtatcagcgcagatgtgtgtcagcatcgtcgacgaggctgtgttcgctctgcgcgagcaatactttgatattctggcgtcgctttacggggagatgaatttttataattattatatttataagtatacgtccctgactggcgacatcaacccgtttaacaacagcggcgacggcggaaagggcgcgggcgacaatctggaggcatatgatatcttccgcgacgacttccgtgatacagccttctttaaaccgctgcaaagcgatcaggacggcagcgcgtccctgtcgttcacactgccggacaatatcacctcctggcggatcacaacgctggctgtgggcaataacctatatgccggagcgtcaaaatcaaatctggttacgacgctgccgttctttaccaagccggttctcagcccgaaatatattgagggcgacgaggtcacaatgcttattcaaggacacggcacagcggttaaaacaggcgatgtgatcagctatgaggtacgcgtcaccggcgacggcgtagataaaacttatacgcgcagcggtacggcatatgagccggttgagatcaatctcggcaagctggccgaaggagactataccgtcacgtcgaccggacagttcggacagatgcgcgatacagttgaactgccgctgtccgtcatcagcagcaatctggaactgattgtcaaccgtgaaatcgacctgcaaaagccggtcgatatcgaggcgctgcgctatccagtcgtcatcacgctgtatgacgacgcatacagggcgtataacgacagcatcagttcactgctgcgccattactgtttccgtatcgatcagcgcatggcgcgctttgcggccaaacgcgcgctgatgcagtttggcgactcggaggatctgccgcgccatatccgcgtcagcgacagcgacgtgttgggctatcagaactttgacggcggtatcggctggtatacctacagcgatcagtccgatccggtcgtcacgatgaaggtgttgatgttcgcgggcgacatgtatgatctggagcgcatgaaaggttatttcgaggcggttaaggacgatcagacacgcggcgggactgagcgggcggctgcatatgccgggctggcggcaatcgatccggcttatacggcggatatccgggagatactcgcctcacagccggatatgaagctgaaggaacagctctattatgtcgccggcctggcctatggaggcgacgaagcgggcgcgctggcgtattacgaaaagtttgtcacgccgcgcctgcgccatgatatggagggcgcaaaatggcttgaatattcaaacgcggtacaggaatatgaacgcttgaaggaaaacgacgatgtgacggccgccgcatggatcacggcctcaaagctcaaccttccggatgcggacggctttgcggcgcattttgcacgcaacagatggcgtatcgattccatttttgaatgcatgatctacgtggtcaattacgggacgcctgcgacaaaagcggcgaaattcagctacacatccggcggcgagctgcacgaggtggatctggcgggttatggacgcaaatcgatcaccctcaatcgaagcgaaatgcaggatttggcgtttcacgacgtgccggactcggtgcgggcggctgcgtactatattggcgaaccggaggaggcaggctttgaaggttccggaaatatcagtatgcaaaaggattttcaggagatggaggacgggaaatacaaggtgacgctcacagttacatttgaggatgacgcgccatatgggttttacaatatcagcgattgggttccgtcaaacatgcgcctgcacacgatcgccaagcagccgcaaagctccagggtggaggtgcacagtgaacaggaaaaccagaagctgtattttgatttttaccgcacagcttatacgccgaaaaccgtctatatcaactattacacacagcgcaccttcgatacgcaggcagtggccgaccgcgcgtacctgatctgcgcggaaaccggagacagtgcctttacagagcgcggccggatttgacaatattggaaatattctctgcaaagtattgcattacgggggcgttgtaagatacaataagaacaggcgctgatttcaggcggcgcgggccgccgcaagaaacgatcagaaagggtgtttacaaatgcaaaagtacatgattaagctcgacacaattgatatggtcaaaaactttgtcaatacggccgccatgttccaggaggacgtcgatctcgtttccggcagatatacgatcgacgccaagtcgattatgggtattttcagcatcgacctctccaagccaatcgagatgattgtccatggcgacaacgacgcgaagtatagagaacagctcaaggattatctcgtttgactataaaaacaaaacagccccgcgtgcgcggggctgttttgtttttacatgcctgccgccaagcaggcagctatgctggacagcagctttttttaaacgcctattcgagcgaagtagctgcggttgtgaaggactgcctcgctgtcggggcgaacgacagcggccagattgttgtagcccttggcacgggagtgatcgccaagacggtcgaagcagacgcagagctgtaaaaagggaatatagtcatagcagtcggcgcggacaaacgcgccggttgcgtcacagcgtttgcatgacgcggctgtgcggtaccagaagattgcctgatgatatgcctgccgctctaaaaaatgcgctccgatgtcgcagcaaagctccgcgcgcggcgcatcgtattcgagagaacgcagcagggcgcgcagcgcgccggattcatcgccgagctgacgcagacaggttgcgagctggcggcacgcctcaatgttattttcaatccagccctgcccgccgtccaaaaatgtccggagaacctgcgccgccttttcgtattgtccatgccagaaaagttcacgcgcatagtaaaactgttcacgcggacagaggggctggccgcgcgcgatcagcttttcaaagatacgcagattgcggtccggatcgccggcgcgcagcttgcggtgggaaacggcgatatctgtatgaaggaccttgccggcgggtgctattgcttcgtgaatcgcgcccgtccagaacatgccggcgccgcgccggattaagcgttcacggtaataggagagcgccgcccggccggaggcgtcgaatgcggtatcgtatttcatcatgacgaccgcgacggacgggtccagcgtcgctttgagcgcgcataaggcggcgcgcgcctcgggcgcgagcacatcgtccgcgtcaagccacatgcagtagtccatggaagcctttgagaaggaatagttgcgggccgccgaaaaatcgtcaatccattcaaaatcgtaaacatgatctgtgtagcgccgggctatctcccgggtgttgtcgtccgaacccgtatcgacgatgatgatttcatcgacagcgccacgtacactgtccagacagcgcgcgagcacctcgctctcgtttttgacaatcatgcacaaactgatggttatcatctgaaaacgcctccctttggtgcattgtatgcttcaaagggaggcgtccgtcacaatcaggccgcttgaattaaaacaatcaggcgcgtgcaattgccgcgatggaagcagtgaccagctttttaaacagcggggcggctttgtcgccggcttctttgacctcctcatgtgagagcggtctgccgctcatgcccgctcccatattagtgatgcaggagatcccgcagattgaaagccccatatggcgcgcggcaatcgcttcgcaggcggtgctcatgccgactgcgtcggcgccgagctgacggtacatacgcacctcggtgggcgtttcataagccggacctgtcaactgcatataaacgccctcgcgcagcggaatatcgagggaacgcgcgcatgatttgatgacgtcgcgcaggcgcgcgctgtacagatcggtcatatcgggaaagcgcggcccaagctcgtcgatgttctctccgatgagcggagaggggaaaaacgaggaaatctgatcggcgatcagcataaaatcgccggcgttaaacatgggattcaggccgccggcagcgttggtcaaaaacagcgttttcgcaccgagcagccccatcaggcgcgtgggcaggataacgtctgaaatcggatacccttcgtaataatgcacacggccctgcatgataacgacgggaacgccctctacatggccgaatacaaagcggcccttgtggccggccacagtggagacggggaaaccctcgatatcgtggtaatcgatggtggctacggcttcaattccatccgcataatcgccaagacccgacccaagaatcaatgcgacctttggaacgaaatccgtcttttcacgaacactttttaagcacttttccagcttctcataaatctgcatggcctgtcctcccaatataagtctggttgaatatgctacagcggcaagccctttcaggattgtttgctgtttggcggcgtttgtcccgcaatgataccatgtccgcgaaacggcatggcatcattgccaatcaaaaggcggcggtcgcacacacgcgagccgttgggcatgaccccggtataataaccgctttgcggttattataccatatccgcgaagcggtatggtataatcggccatcagggcggaagcgggccgcgcccgcgtatcgccttggccatgacctcggtataataaccgctctgcggttattataccataaaatgcgtataaagtaaattttttgggataattgttgtcatattgctcaatcagaaaacggcgatgttttgaatttataaatgtaatctgcttttgaggtagaccgcagagattttaccaggtgacatttctttcagatcatgagtattataaaagttccattccatcgccaagcagctcaaagtgattcttttccacatgcaaaagcccatcacgctgcattttgcttaactcattagacagcgcgctccgatcaacattcagataatcggccagctgttgacggttaaatggaataacaaagctttgactgccgcttctgaccgcctgataggacaggtaagacaataagcgcccgcgaatcgacttaggggatgtgtgaaagattttgcgggacaagttcagatttttctgcgcggagatggacagaagattacgaatcagcttattatgatgggcacatgcgtgagaacagatttgaagcgtcttgcgcatgtccaaaaaaagtaccttagtggattcggctgccaccacattgaccatcatcctctccccgcaggcgcatgcatacgtttcggcgaagatttgtcccggaccgatgctgtccagtatacttgtattgccccagaattcatcgttttcaattaatacgctgccggacagtaccataccgagcgatgtaacggaatcacccatatgatagatggttttgccttttgtaaaacactgctgtaccgcacccagacaattaagcatagcttccgcctctctgggtgtggttccatagaacagagaggtttttgataaagctttaaaattcataaaatcctcatattcgttgttataacaacatatttgtgatgaaaattatagtatactgccaacagaaagtcaagaacacagttctcttacgacaaaatgaactgtatgcagcaaaagaggatgtctttaaaaggagcatgctccaaatttcagacattctcatgcagggaggaaaaagaatggaaaataaaatgttttgctatcaatgtcaggaaaccgccggctgcaccggatgtacgcaggcaggtgtctgcggtaaaaaaccggatgtggccgctatgcaggatttgttggtttttgtgacgaaaggtttggccgctgtaacgacacagcttcgggcggagggcagggaaataccgtccgatgtcaattatctggttacattcaacctgtttaccactatcacaaacgctaattttgacaaaatggcaattgtggatcgtattcatcaaacactgactgtcaaaaaagagatgttctccctggtggagcatacggaaaagttacctgaagcggccggctggacggccgcagaatcggaatttgaagcaaaggcttcccaggttggcgtactgtccaccaaggatgatgatatccgcagcttgagggaattgattacttatggattaaaaggattgtccgcctattccaaacatgccaatgcactcatgcaggaggatggggagatcgacgcctttttgcagcgtgctctggccgcaacattggatgattccctgactgtggatgatctcatttctctcacaatggaaacaggtaaatacggcgtcggcggtatggctttgctggataaagccaacacggatgcctatggccaccccgagattacaaaagtaaatattggtgtgggagagcgtcccggcattcttgtttcgggccatgatctgcgggatttggagatgctgcttgagcagacacaggagagcggaatcgatgtatatactcattctgaaatgcttcctgcccactattacccattttttaagaaatacagcaattttgttgggaactatggtaatgcctggtggaaacaggcagaggagtttgaatgtttccatggtccgattctcatgacgaccaactgcattgtgccgcccagagacagctacaaggatcggttatacaccactggcgccgccggttatcctggatgcaaacatatcgctggcggtatcggagagaagaaggatttttctgcgctgatcgctcatgccaaaagctgtacgcctcctgatgagattgaacgaggggagattgttggcggatttgcacacaatcaggtgatgacgctcgccggtcaggtggttgaagcggtcaaatccggcgccattaaaaagtttgttgttatggcaggatgcgacgggcgcgctaaaaaccgcagctattacacggaatttgcgaaagcgcttcccaaagacgctatcattcttacagcgggatgtgcaaaatataaatataacaaattgcatttgggagagattggcggtattccgcgggtactggacgctggtcaatgcaatgattcctattctctggctctcattgctttaaaattaaaggaagtttttggattggatgatatcaatgaccttcccgttgtctacaatatcgcctggtatgagcaaaaggcggtcattgtattgctggctttgctgtatttgggtgtaaaaaatattcatcttggaccgactttgccggctttcctcagcccgaatgtcgccaatgtgttggtgaaaaattttggcatagcgggaattggtacggtagaggatgatataaagcttttctttggcgaaaaagcggctgctgttcaataacgcgattgatgtgcgagtcaatggcaagtcttttaaagatcgataaaaatcaaaaggagtcatccaatgatggctccttttgatttttctgtgtaagcgatacaaatgcggtcgagcaggccgttttggtcagaatgtgctgtccgtaaagcagatgggaatgtaaaaggcaactggacagaaactatttttaataatggtattgaagatggggaaaattatggtatgctatcattaagatttatttttacaaaaaaggaggaattaccgtgcgcaaactgttcaaactgcttttgaccaccgctgttgctgcgcttgcggccgcggcgcttgccgcgccggcgttcgcgtcggggctgcgctatgtcgccgaaggatacgacagtcaatttctgctcgatccggatcaggtggaggtggtacaggttatcaaccgcgatttgcatgccagctattgggtcactggaccggatgaccttgcggctgtcatcggagcggtcaactctgtttcctatgaaacgggtattaccgagcagccggaggaggaaggcctgcgcctgctgcacatccgtatgaaggacggtgccacatataattattggtgccacagcaacatactgatggtcgatgatgtcaaatatgcccatgcacagcaggttgaaaagctttatacggctatggcggcctgcgaacagaactatccggccaatatagaatggctcggttatatgaacccatatcgtgttaccaaaatggagcttctgcatgatggacaaaaggctgtttatgaaagcaagctgtccgctacaaaccgcgaagcgattttggacatcacacgtaaactgaaaacagtcaaggtttcttcggtgcatggcttctatccaaaggaccaaattgctactccttcaagcggtcccgaacgcaattatgctatacgcctgacgtttgaggatgggaaagaattctatgacatctacatcctcggcgaccggatcgatatcgctgttgacagcatcccggaagggctgtcgtatacctcaggcgatgcatcgttgctcaagcttctgacagatgcgctcgacgcaaaaatttaaacaatgcttccattaacaaaaaaactcgcttttaagcgggtttttttgcatgctgccatggcattgcacagaactttactttttaaaaaaaattgggtagaataatgattatcggcgcttggacaaggctgccgcagtcgtttcacgaaagccgcatgcgcgcggcaaaaggagggttcaaatgagcaggcggaaaagtcctgttgccacttggctggtggatttgctttattttgcggtgggcagcgtgctgtatgggatgtctgtcaacatgtttacagctccgaaccagatcgcgccgggcgggttaaccggcctttccacactcatcaaccatgtgttcggcacacctattggcaccgtgatttttattatgaacctgccgctgttcgcatgggcgtttttggcgatcggttataagcttgtgatgaaaacagtcgtcgccacatttatggtttcggctgcaatcgatctgatgagctttattgtgacgccctattatggaaatcaaatgctggctgcgatttttggcggcgtagtggagggcttttcgctgtcgttgttttttatgcgcggcgggacgaccggcggaaccgatttgctcgcgcggctacttaacaatcacctgcgccacatctcgatggccaagttgatgatgtgtgtggatgtggtgattgtcgcgctggcaggttttgtatatcaaagcctggagagcgctatgtatgcgctgatcgtcatttttgtttcgacacgcttaatcgatacaattctttatggtaccgatgtgggcacaggaaagatgctgtatgtgatatctgaaaaaaataaagaaattgcgcgtataattatggaggaactggatcgcggcgtgacatttttaaagtcccgcggcgcttacagcggacgtgagggtgaaatcattctatgtgcggtacgccgcgatgaagtggtcaaggtcaatgatattgtgcgcggcgtcgacccaagtgcgtttgtgatcgtaggagaagcaggtgagatttccggcgaaggctttcgggaatatcatcaaaatgacaagccgttgacagagctgctgcaacgcaaaaagagacagggagagacgaaatgaatcgttggaacgaccgggttcgccgcctgctctatggccgctatggtcccgaccagttgatgtgggcgctgcttgtgcttgtgggaatcttcatgttattgcgctggctgacaggctggcgtatgtggtggattttttcggtgcttatgctggcgatctgttatcttcgcgtcttttcacacgatattatgcggcgccgtgcggaaaacgaatggtttctgcgcctctggcggcctgtggccagacgcatttcattggcgcgggaggcggcgcgcgatgtaaaaacgcatcgccactttcattgtcccaaatgcggccaaccgctgcgggtaccgcgcgggcggggaaggcttgaaatcaggtgtccgcgctgcggttattgcttcaagcgcagaacataactatataaaaaaaccgcgtgcaccggacggtgcacgcggtttttttatatagttcaattctgtttaataaattcctgaattaaggatgcgggcgggatcaacgattgatcgattgggaagaaaaacgccgcgcaggcgcgtagccgttcgatggtttcatgatagggagaatcactatccgcgtgttcaagaagcctgcaaagcgcgtcccggtataaaaacggctcataattgtggacggaattgacatgccggtcagcataaatgcggtatgggcggatgtacagatcctctccgcggagcacataatcccacattttcaaggtttcctccgccgcggtgccgcgataataatagtcacgcagcagacggcgtgtcaagcgcagatcgcgagcgctcattaaaagatcaccctgatcatttacaaaatcgctgtgcacgctgatataggttttgactgtgcgatgtccatgaaaagcaggcgcaagcactggattaagcgcatgaattccctctataatcaaatacgtatgattatcaaaagtcaattcaaatgttttttccgcacgtctgccggctgtaaaatcaaagataggaaactgcgcgcggccatcgcggaaaagtgtttgcatcacgcgctcaaaacattcaagatcaagcccttcgacactttcatagttctgatagccgtcctcccaccggggaagttcgtcgcttgatttgtaaaaattgtccaatgaaaggcggttgacgcgtttaccccgcacatgcagctctaaagcaagcttttttgcagttgttgtttttccggaggcggacggtcccgttacaagcagcagatggatgtggtcatgagtaaccatatcacaaatagaggaaatctgctgatagtaagcatcctccacctgtgcgatggcatcggcaggatgactagacagcgcacttgcaatggcagatgtccgcacctgctccataacctggctgtatttcaatatccataccccctgtccggcagttttaaaggcggctgccgttcgttaaaatagggcgggcgcctgacatacgcccgccccacgcttgttctgatcagatgggcgttttccacagcccatgcaaattacagtatgcgaaggcggccaccgcttcgtcatcaaccacaagaaaacgcgcggcagcatcctttcctgtttgcaaagctttgcgctggccgccgtggcgggtctgtaaataaatccatgcgatatggtgctcgtcgctcatcggatgcggcgcggaaccgacctttacacgcacttcattgccctccacttcgacgacaggaacatgcttttctgttgctgcgtcggttgtatttgcgacaagctctgtcattggttcgccacagcagaccggcttcacaccggcatcatggatcataccgatgatattgccacaatgcttacaaatcataaatctgtgttccatgctcatgctgaaagacctccttcaattatgctgctcatcatttatatgtcgacgaccacgcagacacagtggtctatgctcttttattgtaacatgtgtgcaaggttttcgcaagcggcagccttatagcaaaaaagtctttaaggctatggcgtgaagcgtcctgctgtggtataataaccgcagagcggttaattataccggcttatgcctaacggctcgctgcttacgcggcaatcgccttttgatggccgattataccatgccgcttcgcggatatggtataataaccgcagagcggttattataccgaggttatggccaaggcgatacgcgggcgcggcccgcttccgccctgatggccgattataccataccgcttcgcggatatggcataataaccgcagagcggttattatgccgaggttatggccaaggcgatacgcgggcgcggcccgcttccgccctgatggccgattataccatgccgcttcgcggacatggtataataattacaggagtctagcgcattaaaacgctgacctcgctatgaaactattaataatatgattgccgccagtataaaaaatagctgcttcacagctattttttgcgcatctgcccgctctgcaggcaggcgcgtttttataaaatagcccagcgccgggagagcgcatatggccaattttttatcgattgcgctttgcaatcgataaaaataaccacggcataaagaaagggaggctgttcaatgcagtataagaaatttggtgatacgtatgctgtacgcctggaaaagggcgaggaggtggttgcagcgatcaagggcctgtgtgaaaaggaacagattcgccttggcactgttacaggactcggcgctgctgaccgcattgtaattggattgtttaacacagttgagaaaaagtattattctacgacgtatactgagccgatggaaatgacggccctctgcggtaatgtgaccgaaatggatggtcagatttatctgcatttccatgcgaatttcgggcgtgccggcggcgccgtgatcggcggccatcttaatgaggcgcatatctctgcgacaggtgaaatctttgtccggcgtttggatggcgaagtcggacgtacctttaacgaagaaatcggtctgaacctcatgaaattctgaccagatcaatgtccacaaaaacagaaaaaccccttgatttttccggaaaagtgtgataaaataacatagttgattcatcacaatccggatatggcgcagtttggtagcgcgctaccttggggtggtagaggccgtgggttcaagtcccgctattcggaccaaaaagaatgcccactttggataccatcggcatttctgccgatggtatcgggctttttagaggtttttccccctcaaatttcacaggtgaaacaaaagatccaaacggggttttcacagaagctggctggattcgaaccccaaaaaattctttagaaatctacagcgccctttttaaaatgggattttcaaaaagggtgttattttcatatccagaaaaaatcagagtgccaaaggcgtcaatctctcagccaacaggctgaagggatggcgccttttttcatattccgaaaaagggcgctaaattggcactgtatagtaaacataaaaaaatagaacgcgaaattagaaaaaactctacgcaacgagcaaaagctcccgtttgcgttttttggatagattgatgccagcacactgcgccggagtaaggttgttcagggtggaatggagacggacaaagttgtagaagaagatgaacatggaaatgaggttgttggtaatgtccgcgtggaagatctccacgcggatgtactgaacccggtgcagcgccttgacaggcatttggcaggcgaagtaacggtcgcttacaatggtgcgaagcgagcccgaatctttcacaacttccagtatggtgaaagcctgagggctgtccctgcggtggtcgatatggaagctggggagaaaacgcgtcttgctgccccaaatgagccagagacagtatttcctgccttgtatcttaacgacagtttcatcggtgtgccactcgtcggagttgaaattgagcgccggaagcagttgtatggcaatgttttggaatattggggcgaaacaggtataccagttgctggtggaagccgaagccccggtcggcaatcagaaaggagacaggcaagcgaggagtaaagcattccgaatttctccatagcaaatatcagacgaaccaactttttagcagaatgggaaactgcgacatggtaatgcttgccttccgtccgattcttggcgaggtaagcggcaaaaaccgatacccggcgccagacatacttggttgtattgtaaagagcgcagcgcaggtgtctggggccaagcttttccatatatgtgcagcaatttttaagctgcccggacgaatatgcagaaggagacatcccggcgcaggccaattgcttgtcaggagaattaaagtgtgagaaagcgccaacctcagcaaaaatcatagcggccatgcgcagccccatgcctgggatagttgcagaggcctttaaaaaattctccttatacagagtgtgacctgaaagctacttgatttgcaagattggcatatttcggctttttcaatgccagctcggatagtttctttctcactatcagtttttataaaacacaggttaagacacggctggctgccgcatcttaacccgtaagtatgaaaatattttgaaacaggagcaggaaatgtaatgagcggatttacaggccgcagagcttgagaagatcttcccagttgtggtccacttccttctggacatcttcgatcatccactcgttgccgggcttgaacatgtgggcgaaacggccctgcatcttcaggtattcctccaccggcagcttgttcttgggcttgtagctgaggatgtacttgccctcgaccacctcatacagcggccatacgcaggtttccaccgccatcctggtgatctccatcagcttttcactgggatagcgccagccgcgggggcagggagccatcacgttcaggaaggccgcgccaggggtgtagatggccttataggctttttcgctgatatccttgaaattgccggtgaacgtggtctgggccgcgtaggggattccgtgggccgccatgatcctggtcaggtttttcttctgctgcatcttgccggggatcacacttccctgaggggtagtggtggtgtcggcaaagcggggcgttgagctggaccgctggatgccggtgttcatatacgcctcgttgtcgtagcacacatacaccatgtcgtggccccgttccatggcgccggacagactttgaaacccgatatcgtatgtgccgccgtcgccgctgaaggcgatgaacttccacgtttcgtccagcttaccgcgctttttcatagcgcggtaagccgtctccacaccggagatggtggccgccgcgttctcaaaggcgttgtggatgaagctgtccttccacgctgtgtagggatacatgaaggtggagacttccaggcagctggtggcggagcagacgaccgccttgtcctcaggctccagcgcccgcagcaccgtgcgcaccgcgatgggagaaccgcagcctgcgcacattctgtggccgccggacaggcgctcctctttcatcagattttctttcagactatatgccatgacagttttccctccttattcccgaacgtccagatagcggtaggtatctccggtatcgccggaaccggagatcttctccagttccgcgaacacgtgttggatactctctacccgcacgtcgcggccgcccagaccgtagatataattgatgcccttgggcgcgctgacgccggcggcatagagggcggcggcggtttctgcgaaaatggggccgcagtgggcgttgaagctgtcatccttgtccatggcggcgaaagccttcacatccttcagcgcctcggcgatcgcctcggcggggaacgggcggaaagagcggattttgatgaggcccgcctttttgccctgagcgcgcagttccaaaatggcctgcttggcggtacccgcggaggagccgatgatgataatggccatctcggcgtcatccatcatgtacttctcgatcaggccgtactgccggccagtcatggcggcaaattcggcgccgactctcttgatgacctccttggcgtccatcatcgcctgggcctgctgacgcttggcctccatgtaataaacgggggtggcgtaagcgcccacggccattggctcgtccttgttgagcaggcagtgctgcggcttgtactcgcccacaaactcccggaccttctctgtctccaccagctcgatgttctcgatggcatgggaggtgatgaagccgtcctgacagatcatgatgggcaggcccacagcttcgccgatgcgcatggcctggaggtaattatcatagacctcctggttggtttcggcaaagagcatcagccagccggcgtcccgcacacccatggcgtcggaatggtcgttgttgatgttgatagggccgctcagggcgcggcaggagactgccaaggtgatgggcagacggtcggaggccgccacgtacagcatttcggtcatgtagcacagcccgcaggaactggtggcgctgacggcgcggcagccggcggcctgggcgccgatgcaggcggacatggcgctgtgctcgctctccacggcgataaactctgtgtctacctccccattatccacataggcggagaaatactgggggatctccgtagacggggtgatgggataggcgcccatcacatcgggattaatctgtttcatggcataggcgacggcctcattgccggaaagtctttctctgattcccattgtcgtttcccctccttacttttcatccttgaccatggtgatggccccgaaggggcaggcgttcgcgcagatcccgcagcctttgcagaagaaatagtcaaaatcctcccgcttgccttccttgttcacggggatggacatatccgggcagaccggggcgcacagcaggcattgcttacacttcgcccagtcaatgacaggctttatggtgcgccagtcgccggtctccacgacctgggatgtgccgccctcaaaaatattgcagccgggggtgatctctttccaagtgacgctgggcgtcatatcctttgccagatggctcatcctgcctgcacctcctccatggaacgcttcaaagcgcgcatattcccctcgatgacctgaggtttggaggcaaacttgtgatggaaagaagcctccatatctttgacaaacgcgtcaggctccaccacaccggagaccttgacgatggcggccagcatgggggtgttgggaaagttcttccccagttcttcctcgctgatcctgccggcgtcgatggtgaatacacgtcccgcataccccttgagcagaggccgcagctgggcaggggacttgccggagttgataacgatggcgccttccttcttcagccccgcagtcacatccacagcggaaagcagggtttcgtccaccaccaccacgtaatccggctcatagatattggagtgaacagtgctgcgttccgagctgatccggttgtacgccgtgataggcgcgcccatccgctcggggccgtactccggaaagccctgcacgtactttccggtgttgaacgccgcgtctgccagcagcagcgacgctgtcttcgcgccctgaccgccccggccatgccagcggatttctacgatgtctttcataaatggcttctcctttttaagcaactgtaattttgtttgcaaaatattttaaatgaatcgggatactttgccaatttgcacatcttactcttatgacagattttggacgccaataaggtgtgatccagtcttgaccacaccctactggcgcctgcgtgagagaaggatcaaccctggttatggaggagcgcaaaaaaagcatggaaagcggcaaaatctgtgatgcagacctcctcggtatcaaatccagggttgtggtgggggaacacaattacctttcataaacgcactgagcagccgcagtgcgttcatacgcccgcgatgctcgcgaaaacaagaatcaggcaggagacaacgataaagatcgcggtaaagggcataaaccatttaagccatctcttgaagggaatatttgtaaatgcaagaggagccagacaggcggtgggccagatcatgttgctgaagccgtcgccaaattggaatgccagaacagcacactggcggctaacgccgatcaggtccgacaaaggggcaataatgggcatggtggttgcggcctgcgcggtaccggaaggaaccagaaagttaaagaagaactggaatagatagatcatcagcaatccaaaaatgctggatgttccggagagcagttctactgccgcgtgaagaatggtgtccagcgtgtttccctgttccaggatagacaggattccgccggccatgcccaccacgatacagggcaccagaacggtcttgacaccctcaacaaatccctgggatatttcattgtaattgttgccgttcaccaccgcgacaataatcccgcaggcggtgagccaggccgcaatttgaccgctgctggtcatatcaaaaaaggcgatcatgattaccagaccaacgaattccgcaaccagacatcccaacgcaaccttgcggcggggcgtcagttccaccgcgggcgctacctccgcggccagattctcagaggtgtcgcaaagatcgtatacgatgctttttgacgggtcctttgcaactttgcgggcgtaaatataggtgtatcccagaagcagggccatacataaaacccagataaaaagccgcagccctagtccggaaaataagggaagttcactgatttgctgggctacgccggtgttccacatattcagcggtccacacatgtagccgatattatttgccacggctaccgccacaaatgccacaacgatatcgtaccccatggcagtggtcatcagggctacaacaggcgtgaacgaccagaagctctgctgaatgccgacaaatgcgccgcctgcggaaaataggaggctgacaaggacgatgaggaaaaaagacgcttttttctttccgcacagagcattcttgataccgtcctcaatcaggtttgtgtggattagaattccaaaagcgccgccccagcccataacataggcgatgacggagatatttttttcaaatccgccgggaatggcggccagcatgtccataatgccgacaggggtctgttcaataagctgaaaggtattgggatctaccagcgtgcggttcagttcctcgttgaaataacgtgtgtatgatcccgctgggacaacccaggtcagaaccatggcgatggccatcatgatgaatgtgaacacgattaagtccggggcctgaagctttttcttcattctctacttccctcctgtggtgattatcagtgattttgaaatttcaatgttcctgtgtccccctttcttttcaagcctatcattcaatttgaatcaaaggtcaagtatgtattttctctaaaataaggcatttgattttggctatataaccgaatggattgaaaagagagatttcccagactgggcacaaataagaacttgacaaatcgagcgttttgacgataatggtaaaaaatcagttggagggagccggcatgaagacagcggtttattttggcggtacgtttgatccgatccatcaggaacacatccgggtctgtgatcttgcgtacaacgcagtgaggcctgataagcttatgctggcgccggctccggacggcctctgtaaacgggcggcggcatcggcggagcaaaggctgcaaatgtgcaggattgccgcccgggatcgtccctggctggaagtttccgatattgagatcaagcaaaatgtgcgctattcagcagacgccctgttccatttactggaacagggcgaatactccaaaatctggtttttgctcggagaggaccagttcagcaccctgccgcagtggcgcggctgggaacgcattgtggaaatcgcggatattctggctgttcgccggaatggagaactgctttttccggaaaacacagcccgtgctgaacacctgcttcagcaggcttcggcacgggtccgatggcttgacgaaacgcctgcggcggtttcctcctccaaaattcgcaaagatttgctggaaggcaagcggccgcagggattatccgacgcagtgtttgcatacatactggagagcggattgtatacaggaagctcgttggaccggtccgctgcacctgcaatactccgcaaagcccgctgaaaaaacgctgtaccgtgatccaaaaaaggaaaatagaaaaatttttgaaataatccttgacttttgaccttcctctaatgatacattcaagccagagattcatggtgactgtcatttttagacgggaggtatattttatgctgatccaacttcctgcgcacagtttatatggcaatgagccggttgacgtgcagttcccaaatgactgggacgttcaggtttcaagctttcagggagagagcgaaccggctctcacagagagggagattgcagaggccatccggcatccgaactgtactccgcctatccgtgaggccgccaaaggctgcaaaaacgcagttatcatcttcgatgatattacgcgcgctacgccggtcggccccattgccaaggcagtgattgcagaactggaggaagccggggttcccagagaaaagattgagttcatggcggcggtgggcggacaccgggcgatgtgcagggaagattttgtgcgcaagctcggggaggatattgtcaatgagttccgcgtctggtctcacaatcctttcttcaactgtgtatatcttgggaaaacaagccaacaaattcccattgagctgaatgcggagtgtgtatatgcagactttaaggtggcaatcggcgcaatcttcccgcatgtttctaccggagcggggggcggcggaaaaattattcttcccggaatagcttccatggagacgatccggcgctggcacctcacagattccggtatgtggctgaccgacagcgattgccgcaaaaccgttacagaagccgctgatttgctgggactgaatataaagatcgacgttttgatgaacggccgcggagaaattgccagggtgtatgcgggagactgtgagagcaatcttcaggatcattatgacgagattcagcggtttttctgtacgcgtcatgtaccggatgttgatttggttcttacaaacaactatttcaagcccacagagccaaactgcgctctggtgcagatgggaatgctggaaaccattcggccgggcggggatatcatcctctcataccacagcccgcaagggtgcgcctgccattatgtttggggaaaatggggggattccgggatcggcgggtgtatgtaccgcaagcaatggcgtatcccggagaatgtaaaccggtttttcgtgtttacaaaatatccggattttgcaacgagttcctcgtaccatttgaacgaggacggcaatttcttcgccagacaatggggagaaattatggacgcgctcgggaaaagcccgcgcagggttgcggtgtatccttacggggatgcctgctgctttgaagataaaatggggacccggtaatcaccgggtccccagaaaaaggccttatagctgaatttgaatttcaaagcacgattgagtaaacgcctggacggagtcatccgtgctgtcctcaagctcgcaggcaagtaccagccggggaacctgatcacaggacagaaggggaagaagcggagagatctcggcatcccttttcagtatatggctgcggaagcataaaaaatctccggccggaaccatctggacattttcgcaggactcagggggcgcattcgccagcatcataaaataatgggtggggcgcacccgccctgatttgaattcgtcgcggtccagcaaaaagccgatttgccgcaaaaagttgagatctgagcaatcaggggcgctctttcgcaccataagccgatagcccgcggttccgtagagcgattcgccggggcggtatgcctctgcaaaaagatagcgtgtttcaaaatgcgccttaaacggcacattgaacagcatctgctcatcggatcgctgatagtagcgctggtattgctccactgtgtcgcgcagcgttgtcaaccggctgatctcgcgatccagttcctcctttttgcctgaaagcagattccgaaatgtatccatagtcgtatcagagataatggcttggatttcttccaggctgaattccaaatgctggaggtgccggattctctccagcgtaaagagctggtgataggcatagaagcgatatcccgtctgctcgttgacgcttgcaggctgaagcagcccaattttgtcgtaatagcgcagcgtatggctggacaagccgaggagatgggagatttccccgatggaaaaatactctttcatggcggaacctcttttcgtgcttatcccggaaatccggatcaatattgaatacaaggtaacaaaatcatgaaaaaatgtcaactataattatttttgtctaacaagagaggatgatgacgatgaaactgatgcacacaaaactgcctgagtttattcaaaggctccaggatgcggctgtaaggcacacgccggagatgaaaatggaaattaagggcatggaaaatgttcactctgcaaaactgcagtccctgcgtacaggccggattgcaaacgcggttgaggagattgcctgcacgcagggaatagaccatattgaggttctggtacgtccgcggatgccggaaaccatgcacacgcttgtgattaaaggctacgataaggacggcaaagccaaaaaggccattgtggaaacggttgatatgttggttcccaccgaggagctggatctgttcgattgtgaagaggtcatcgacagaagaccaaaaatgacagtatacacaaaaatttagatggagggcaagtgaatggttcgcctgaaatatagactgctgcctgaactcagcgtggatggtattttgcctctggcagtggcgctgattgactatcaggacattttggatgtgggaattgatatgccggcggcgtgccaggcggtggcaaactgcatagacggtccggtggccatcaatatcattgatctggatgccgtgacaaccaccagcgacggcatcatgattcccagtgcaatccggtccatggcggccgccgaccgcgggaaaatccatccggagtttggatatatccctatggcggagatcccgcatacggatgagatttttgcccgggagccgcacctgcggcagtgggacatcaactatccgggcagaaggctcttccgggggccggatgtggccgacaaggcggttcccgtccataatgttgtcattacggggcgcgcctgcaataacaactccggcacggaaatgatgcatcttgttacgatgggagagatcctcatgccctatgttgggcagcatgtgatcatgaccggggaggggcggctgcttgcgggagagtcgggcgagcacatttctgtcggcattggaatgactgtggctgaaaaattcggccgggtgttttccacatacaggtaccgtgccggcgatacggctcatggttcgggcgaacaggcaaagacgctcaagcgggatattccgtgcattgtggcggataagcgcacacatgcagaatttgtaatccgtgctttgaaagccggcatggtgcctggccgggacattggatgttctccggtcaacctgtccattgcaagggcgctgcgcctgccgatggatctggataacatcactgcccgggcctgggctgaattacaaagcgtggacattacccgccaatggctggagatgcctgtgcaaaaactcacggaagaagatgttttggagaatgcggatgaaattcttccgggggtcgtcaatccccggacgtatgacgtgaacgacgttgttttcacatgctttgcggaggttggcagatgatttctcaggaatttatcattgcggccgcggataaaagtattttgaaaatatccgggattcatgtccgcggccttaatacacaggatctggaacgccgcctgtcggagcggctgcacacgcttgtgcgcgtgatcggcgttaccggagaacagattgagatggatgtatatgggattgatcccgcgcagatacgcaaggatgagaaagctgtgattcaagcgatctcccttgtggaggggatcagcgccgaagacctctgtcagatttctgtcagtgagaaaatcatagatgtcaatattgacgacgtgccagacaaaccctatcacggctgcgcacgggaaagatggattcgggcttgatgaatcgtatttggattattccgacgggcgatgaaatccgaaacggggtcgttcgggatctggacagtccgatggttatgtcggaaatgctccggatttggccgatggcagagattgtacgcactgctccggtgtacgatgagatgcaggagatcctgaatatgcttttgtctgcgcgcgaggatggagccgatctgacagttttaatcggcggcagcggcggcgggcaccgcttcagccccacgttggggaaggatttcagccactcggcgatggatgtttttctggagcagggagcttccagagagatttatgggaaaaacggacacttgtggtgccgccttgtgtgcggaagaaaagggaagatgcttgtgatcaatctgcctggcccatatacggaggcaaaggctgcgattcaagcgttttcagccgccgtatgtgagacggatgatgtggcggagattaaccgggtgatggcagaggccgtattttcccaatatccggcgggaagtgctgaattgtgatgaaaatggactgttttgcagcaaaagtgtgcctgagagaccggacaaagattttgattggcggattatgcatatcaggagtggttccagagcttctgcgccggtgcagaaagctggaggatggtactttgccggtgaatacggttgtggggattgaccgcgccatggcgcagatgctggatacgttgcagatggaaggggttttcgccgcaggagcggcggcttcatcgccggaggcgtccgcacgatttgcaaaagccggatggaggacaggcggtgtaatcgggattcccggaacgccgccggagtctgcggatgatcagatggaaaggacaaaagatgggttgtatctattttccagagccggcgggccgggctttgccgctgccgtgtccgagaaacaggcaatttatctgtcagaaatttccttgactgtgccgcctcacgaattttgcagggaaattcaaatccttgccgcagatggatatctggcggtatttgacggaattggatatcaggcaaagtgtattttggtcgtgggagcagggcagcagcgcttttggctggagtcgtaaactgtcagagtcagaaaaccgatgataagaaagcggtataatgaacatactggcaattgacggtccgggtagcatctgattttcaagatcatcatattccacccgtgaaatggtcgccgtttctacaggacaccatccacgactttgaaattacagatctttttataatgcttgggcaaagatatttgaagcatggttttccatttatccagcggttggattctgaaatagcattcaatcgctttccacagcaatgacaatgcacaattctttccaaaaaagcatttattcttcaatgcggacggttatagcgccctttttgaaatgggattttcaaaaagggcgctattttcatatcccgaaaaaggatgctaaagttacagaggagggagaataactgttatgccggggacaaacgccagcggctgctggaggatatccaccgcgcaaaacggctccgatccctgtgctgacagaatcatcgggcggaccgcacataagtgcgagggttgcccgtatccccaacacggcgcttcatctgttggggcagggatggaagctgcatgcgcaccgatatggaggggctaacccagctgcattgaaggacaaaaaagggccggcgattttgtccagtattgtgtgtcattaagaaacggaagtgaagcgttgattttcaacgcgattctcaaaaatccaaaacacgaagaatatggcgagacaacctccctctttccaattccgcccaatgagtatgaacccattttggagcatctggaggtgttggagttggggaacgccgctctgcctgaatacggcctgctccgaaggtaagatggttactcctgccccgctttgaggcggtgctgatgagtatgaagtcccgcccgggccatgtggtctacatcgatttcaatgtggagctggtcaacctgttccgctgcgtcaaggagcggagcaacgtcctgccggggctttgtgcccgagatttggaacgcggcgattggacgggacttcccgtctaatcggggtgaagcgagggatcgcaaaaaaggcaggataaagcggcggcgtcaccgccccccacaccgtcccgcaacacgggccgggaatctgcatgaacagcggttttgtgtagataggcagtttccgccttttatggcataacaaagatcgggtgggcatttaaagtgacatagtcctatcataaaactgcatggccgcgcactttcaggagctattaatgtggtgtacaggaggaaaatcgaaatgaaagagaaaatccgctttcagatgcgtatttcaccggaaacagatcaaaaggtcaaagcggtgcccccgcttgcaaactgccagagtcagaatgagtttgtggactggctctactccattactgcagctgtttgcaggcggcggaggccgcctgcatccgcgcgccggaactcaccgtcaccctgcgcatgacggtgcgggacagcgcgacgcacacctgccgcctgatcttcaagctggcggtggaggtggatatgttgatgcatgtactggcgtcggggatggagatcgacccggcagtgctggataaactgcgcgggagatgtgtccaagagttaatgtccaccaacggcggtagctacttcaaggatgcggtcaactaccagaacggcctatagcagatgccccgcctcattttcaattgtccatacattaagggcagcgcgcaaaacgcgacacggcgagagaactatgttcggtacatctccaccagagggggcatcgaactgatccgcccggataatgcggacagccccgtaacgtcaagacaaaaggaactgctctcaaacctgctgcgggatttcccagacagcagagggatgttcgagtatgaggactaccgtgcggctcccaccaggggccatgcctcggagctgatctgccggatcatcgaggagcatctgcaccagatgtttggcgggaaaagtatctggattacatcgccaaccgtacccgcgccgagaagctggggcgcatgccctgtttaccgcaggtgcagattcaccggcgctgtcccaggtggtggaggaggtgttcagacacaccggaaatctgtggctgcccaccctctccctgcggcgtgaggatgccgcccggctcgtctatgaaaatgccgaactttcgctggtacgtcgtttttcataacgagagccaccatccccatgtgcatatggtctgctatagcgcaaagcctatcgtcatcagggaggcggtgaggctggaggagctgtctgccgtttaaggcatgttttgacagcttcgaccatcatgttatggtgaacttcctgcgggaacggattgaggacgaaaatttcctcgctcttatctggaaattcctccgggccggatatatggaacagtggcaataccacagaacttattccggcacaccccagggaagcggcgtaagccctattcttgctatcatctatctggacaagctggattactttatggcgcagtacaaaaactgcttcgatataggctcatcgaaaaatcgaaaggcagacagcggctacaccagatcaagaggacaatatcacaagttgaaaaagtcgttcgcacccaagtggcaaacagcgacgccggaagaaaaagcagaaatggactgccggattcgcaaaacaaaaaacgagatgctgtatgttcccaaagaaaagtggatgagaaagctgctggaataccatgctttcaaaatcaagctggatgaaaacgggaaagaaacatggaaaacgatacatcaaggcaaactcatcaatcatcctgatatagaaatcataagcaagttcaacgtggaaatcagagacctgtaccactactgtcagttggcgcacaacgtgtctgtacttggcaagttcgcgcatattatggagtacagcatgtacaaaacctttgcctgcaagtaccgcgcaaccgtgagcaaaataatcgattaatattcacacaacggaatattctccgttccttatcaaacgaaaaagagccttaaatggtgtgagttttatcattgacgatttcaagcggattaaggaagtgtgtctggctgccgacacattgccggaatatgggcggaaatatggcaaccccaatggcaatgacgcccgcatcaaacggagcgtctgcgaattgtgtggacagtcgatcaaggacatccgcatgtaccatgttggactatagtcaataagtaggacaagtaaaaagccgaaaaaagttattttcagcttgaatgggagagaggccgtgattgtgagaatgagggcggacggggttgtagaagccgtcaatgtaggtaagtaggttgtgctttaattgatcgagagattggaaatgccgacggtccagttcctcttttttcaggtatttgaaaaaacactccataacggcattgtcatagggatgccccttttttgaaaaagattggaccatgtgaagggaatccagtacttttcggaaatcggcagaagtaaattgagcgcccctatcggaatggaacatgacgccctgagaaacgcctctgttgtggacagcgtcccggagagtcttcagggcgaggaaccggtccagccgggtgccaacccggtaagcaatgactctcctggcaaagaggtctagaataacgcagagataacagaacctttggccaacccgaacataggtaaagtcgcagacccagaccagattgggagccggctgatcgaatttttgggcgagcagattctggaaagcctgggaatcatcggattgtttgggaggtctggggggcttgacagtggacatttcagggagattcatttctttcatcagctggtacacccgaccttcactgatggatatgcaaaaatcacgcgcaagacaaagcccgattttgcggcatcccaggcgctgaccggttttggcgtagatctccagaatcttttgccggatgtgctgtcctactttttagtatacatcaagatattgaggtttccaaactgtgcgtgggctgtatgagcttcggacaggcgggaaccatgcacgactggacactggatgaacagcagagcgaagcggtgattcggcgtgccctggatttgggcataaacttttttgataccgcaaacggctattcagccgggaccagtgaggaatacctggggaggatactcaaaaagaatattgccagaaacaaggtggtgctcgtctccaaagtgtattttaacgaaggccgcctgtcgaaaacggcaattctgcaggagatcgacggcagcctgaaacgcttggggacggactatctggacctgtatatcatccaccgctttgactatgacacgcctattgaggaaaccatggaggcgctgcatgacctgatcaaggcggggaaggtgcgggcactgggagccttggccatgtacggctaccagttttacaatatgcagacgacagcaaagcagcacggctggatgccgttctcagctatggagaaccgctttaatctgatttaccgggaggatgaacgggagctgatccccatctgcaagcagatgcaagtatccccgttgccgtacagccccctggcggcgggttatctggcgcggccgaagtggaggtcggattccgttagaggaaagacagaccgggttgccgtcgggaaatatgaccacatggagcaacaggatattttggtggttcagcgagtgcaggagctggccgagaagcaccgctgcaccatgtcccaaatcgccattgcgtggcagtgggcaaagggcgccgcctcgcccatcatcggcgcaacgaaggtacgatatttggacgatgcggtcggtgctctggatgtggcgcttacattagaagatgtggattatctggaaaaactctatgtctccaatcctattgtaggagctatcgacaaaaatccagagcagggcgtcatgctgctggatgagaagaaataggaggaacaaaatatgccctatgcagcaattgcgacggtctccaaccgggacgatgaagtcaaatacactctggttcagctctatgcaggagctgcttgcgctctggagcagttcgacccgcatcgcgccgccatttaggagtggttgatctatggtctacacagaggacaggttgtctcaagcaaatgtggcagattattaattttgacttcacaagaaacaaatttaatgatacaattattaaaataaaattgtttcatataaagatattatgaatttgacaacagcgattttttgattatttatggcgcccatttggcaatgtccgtgagctgctgaaatatgcaagaactggctctcgagaagataaaatctatgctgtaatttgactgaaaagtaaaccgcgcttttccggaacccagattgtgtgatataataaaacataaaatgttacctatttggagtctgtgatcagaggtcttgctatggaaggtgaactggggcagccgttaaatgctctgctcaaatatgaaaaattgattttgtccaaagaagaaaccacatccggccatggatgcggcttctttcctgcggacttttcatgccctgcgccagtctgtccctgtgacagtgcggcgcagggcttttttctatcttctgaaaggagttaaagcgtatgagcctgaaacacaattgtcccgtctgcgggacgtccttaggagcggagactggcgggccggcaggaaatctgctacagtctgagaccgtacatcaaaaagcagatgcaggcgcgggggtatctgctgctcctcaagctgagccgggcatacatcagaacccggacgcccagaagctggtcaaggaaagcgcaaggtatctggaggaagaaaagatctttgaactggatatggccgggcaggaggaatttatccggcagaagattactgctgacgagagaggatgcataaatggatagcgggaaaatcatggcctttttgcaggagcattggtgttttgccgccctggtcatgggcgtgctggtgctgattggagccgtccggaactggaactggctctgtgatccaaccggcacaccggatgttcaccatcatggccggggataccgacgggcgatcttctttctgctgggaatcgtgctgatcgtggtgagtatctggagcttcgtactggtattgtgaggaaatttggtatgaacatacgaattcaatcctttgacaatctgcatgacaacagagttctgcgttattgtgccgattttgaggcgaataccctgaacatggacacccaaaccgaagccggaaagatcgtatccgttcacttttcaggtctgctggcccactggtttgaaaatgtgatccagaacaacatcctttttggaatggatgaaattaccgttagcggtttttttgagcagtacacagaatagctggaccgctctctccaatacggctttcctgcctgctgtaacgccgaggaactgcggcaaaggatgacgcgggagaatatacggatatttgttattgattccgccctttgactatgtgggtttgtgctggctcagaggatggaaatacaatggctctaacggtttatgaagcgcaggcccacggtcatgactggaatcatgatgactatggccatgtaaatatcatttaccgctacggcaacagcaagccccgccccagaccagattggtgcaagaggatggaggccatgtgggcggataaaagtgtctacgggcgcctgtccccggctgtaaggcgagctgccgccgggagcagccgggcgggcggatgggacagaggctggtgtttcagcctggggatgggctggagctggaaattaaggaggaaaacaagatggaactgctggaacaatgccaaatttggaatgaaaacgacgaataccaaaagatcattgatgcgctggaggctgtccctgccggggagcgtaccccggagatggacagcgaactggcacgggcctacaacaatctggcggaacttggggatcgggagctgtttaaaaaagcgattgctctgctggccccccatgaggaatattttgaaggcgaccattgctggaatttccgcatgggttattcctattactatctcgaccaagagggccgggcactgccttatttccgcaaggcgctggaggcccgtcccggcgacgaggattcgcagatgctcataaatgactgtgaaaagcgtatcaccctcccacgatttgaaaaatgcttccgggagcggacagaggcggcatgggaagcctttgcccaacaggaggccgggctgcgccgatttatggacgaggataaaaaccgtgaacgcggcgaggaattgatcgggcagtgcgaaaaaatcctgaactttgcttttgacgaaatctgttttgagatgggcttcaatggaaaaaagcatgagctgatcctcaccccggagggaaatcgggtgaagctgttccagcttgtttactttcagaagcacgcgcccaaagaggtgctggagcactggaacatcctggtgggccgccagtccaatccgaacatcggcctgcgctctggcggctgggagatttccggagatgatgtgcagctctggttggaacagcagggcgaaaacagctttgctctctcagcctactgtgaaaaactgctgcccctgctccgggaggatgagaaccgggtatggtggattctcaccaacctcaccgaccaggtgctgggcgaaatcccccatatgagatacatagactcttttgatatgctggagactcccagagaggagccttgcgttctcctctcgaagctgccggacgagttaaaagggatggggcttgacctttccatcgacccggaggttcttttggagagctatactgggtatgagatgaaaccggatgaaaatcccgatgctgattggcggctggatattatcgccggcatcacctgctgcccgccttttatcaacgactacatgagtgcggagagtggctgcatggacgattttcacgctgacggcgctgtggcgggctttttctgttatcctctggataccctgcgcgatgagaacggcagtcagaaaatctttgacttccgggagaagctggagtcggtgctgctggcggacgctggggaggatgctgttactctgaccggcggggccaccggtctctactgcggttatgtggacttcatcgcctgggatttgagagccatcctgaatgcggctcaggagttctttgacgaaaccgatctgccctgggcaagcttccatgtgttccgccgggatgtggggacagtgactctgaaggaaccggaaggggataagcctgaagatgatgggtttgatgacgaagaatccctggacaatctggagtacatcccctacaccccggagaatgcagaggcattttaccggcagttggaacggtggaacgacgaggacgaatacacccgctgcatcacggtgctggggacgatccacaaggaccagtgggactatcgcgccgcctatgccatggcacgggcgctggaaaactacgccatcattgggggccatgaggagggtacccccaacttcaagggggataaggcgctcctgcaggctattgagatgctggagtccgtccgggaggagggccaggacaaggcggagtggaatatgcggatggcctacggctatcagtatctccacggccaggaggaaaaagccattccctacgcccagcggtgggcggagctggatccggaggatgagaacgccacggcggtgatccgggagtgccggcaggagatccggaaccggcagcgcagccggaaaaagaaaaccaggtttgcgcccggtgacactccctttgaaggctttgattttacagacttttgggatgatgatgagtacgctctgaaagagtatgtcagtgagccaccctccgatgaactgatcgccagtgtggaggaggagttgggctacaagctgcctgcctcttatatctgcctgatgaaacagcacaacggcgggataccggccaatacctgctatcccagcgacgaaccaaccagctgggcggatgaccatatagccatcaccggcatctttggcattggccgggagaaggactattctctctgcggaaagctgggcagccggtttatgatcgacgagtgggaatatccggccatcggcatagccatctgcgactgtcccagcgcaggacacgatatgatctttctggactaccgggactgcggcccccagggagagcctgcggtggtccatgtggatcaggagaacgactataaaatcacccgtcttgccgacagttttgaggagtttatctgcggtctggagaacgagtctgtctatgatatggatgaagatgatgacaacgaggatgatgacactgacgaagaagccgatcaggatagcaggggcgccttcgccggctttgtcctgatgtccaaaggaagctgggacaaggcccagttcattcaggatatgaaagcaaagtgggacatcaccgtggaggaggatgaggacgggggcaaccgcgacgacgctgtggtctttgaagtgggcgacatgatcgccgctgtaagcctgatgccctatcctatccctgacggcgaggccgaactgaacgcagaaaacaactatatgtggccggaagcggtcaaggcggccaaggagcactgcgcccatatcatggtggcggttctgggtaaggaggaaaatctgctggagcgtggcaagctctacgccaagctgatggccgcctgctgccgccagaaatatgccgccggcgtctacaccagcggcgtggtgttcgagcctcggttctatgagggctttgccgatatgatgcaggaggatgaactgcccattttcaactggatctggttcggcctgtatcggaacgagggcggcatgagcgcctacacctatggtatggaggtgttcggcaaggacgaaatggaggtgctgaacgccggcgccgagccgggagaactgcgggacttcctggccagccttgtgtcctatgtgctggaaaatgatgtggaactccacgacggggaaaccatcggtttttcggcagacgataagcacaccatcacccgcagcaagggcgtggctctgccggatcagatgaccttgaaaatctcctatgcgcctgccggggacgatccagagcaggacgatgacgacagcataggcttggacaatgcctcctggcacatggaaagcattgaggagaaagaactggaaatcgaccccatcaatgcctgcggccacatggcaatctacctgcgctggtgcatagagcatgatctgatggaagaaaacttcctgtcagagcatagcgaagttgtaaaacaggtcaaagccgatcctgccagcgtggatttgcgggcgttcatccgtgagaagctgttcggctgcttgtactccgccctgttcaatcaacaaggccgcgcctttgccgggtactactacggagagggcgacagcccttactttcccagtgatgtggatgactacgctctgcaatatttcggcccaaagcggtatcactccaatgaatttcagcaggaagcctatctgttcattccctttgacgaggactattatcaggccatggcaaaggtgattgataaacgttttgccaactggcagggacagggctttgatgaggatactttggagccttccgatgtggctcaggctatcatggagtatctggactgcgagtgcacctatttcccttccatgaaggacgacgaccccatcatgtcggcgtacagctacgcccggcggctgggcgtgcgggagggctttattcccgtgcttgtcaagccggacgaaacgctgctggagtgcctggtaatgaacgccgacccggagaacgaggcggactgctatgaatttgacctcaaaactgtgacggggtaccggaagaagattctggctgctcccatcaaagacggaaaggctgtcttggagcaattggccggacaacgcagggaagaagccgaggatgacgatctggactgggcggaagaagtcctgggcgaaatggaaggcggctatgataactgccgtttctcctgttactgggattctgacaccaacatgacttatccgcttattctggcgaaaattccggtgaagaatccgtgggatatcttcgcatacctgccctttggcaactggaacgagtgtcccgacacaccggagctgatggcggcggcaaaatactggttcgagcagtatggcgcggtccctgcggctatgacccatgatgaattggaatttgaactcccggcccccatttccaaagagaaagccatggaggcagccacggagcagtatggtttttgcccggatattgttgaccaggagcaggatgatcccacagtgggtaacttggcggatgtcctgtggcagtccactgtctggtatttctggtgggattgagaagagaggaggagcgcatcctggcgcttagggatttggccgcggccccggaaatctttgcgcgggccgaaacactgtggctcacctcagaactggacgatctggaggatttggtggataaggctctgccctgcctgatggactgggcagagccttatctgtaatggagagaggcagtctgcacaagcagcaaggcgccggaggaaactttctccgagcaggatcgggtgaatatcttaatggattttgtaaagcaagggtattaccagcaagcgggggcctttgtgaaacagttcagcgagccgttttatcagattattgtctctcagccttttttgttatgttgttcctattattgtttcgggtgtaatgatgggcaacaaaatataaatcttctttctttggcagcagtattatacagattctataaaatgtgggatgaaatatattgtatttatataagaaatacgatataatgacatcgtgaaataatggagcgtgaaaaatgtgatctgtaaaactgcaccgcaggatcaaagtacaattaaatacaacaatatgaaaatgatcctcgatattattcgggacagccgcgaggtttcccgcagtgaaattgcgcgaatgaccggcatgagtcctacaagcgcgacccggattgtcggatccctggaagaatgtggacttgtcagggatatggcggcggtttcaaatggggttggacgtaaggccgtcatgctcgatgtggaggagaacgctttttattgtatcgggctggacatttccgaaaccaatttaaaactctgtatcctcaactttggcgggcagatcgtcgcgcggggcgccgcgccagcgccgggcgattcttttcagccggaggaggttgttgagattttttacaggatgtaccagcggcttgctatacaagcaaaaatcccgatggaaaaagttgctgcaattggggctggcgcggttgggacggtcgactccaaaaccggagaggtcatattcggggatctgatccggtggagtcatgtgccgatcgggcagatgatagaggcgcggttcggccttcccacctatgtggataatgatgtcaaatgtgcgattatcggggattgctccacaccgccgatcaagggggcggatgatgttgttctattaagctttgggtgcggtgtaggcggcgcagtgatccataggggacgcttagtacgcggctccatcaactccgcgggcgagatcggacataccatcgtggactataccgacggccggctctgctcctgtggacggcgtgggtgcgcggcggcctacttgaccaaggaccagatcatccaacaggcggcaaaatcctgtccgggaatctccagccttgaagagatcatggctgcatgggagcgcagggagccttgggcggaagcccttcttgaccggataagcacttatatggcaatcaccgtaagcaacgccgcttgttttctcaatccacgcaatatgatactgggcggaaagctgatgaacgaatctcccttcctgtttgatctggtgctggaaaaatacagtgctatgatgtaccccccgctgcggggagcgaccacttttatccgttccccgctgggtacggacgcaacctgcgtcggcggtgcaatgatcgcggtggaaaaacatgtgtacaaggttatgcgctcggcgtcggagtgatgcgctgcgggcgcggccgtttctgccgcttttttgttttagagccgggattttcccggctgttttttattagataaaaaagctgacaaaaatgaatataaaaatttgtgattatttataattattgttgaaagttgttgacaaatcatgctgttttgttgataatgtagtcatgttatttttttattgccatttaataacgccacgggagaaattaaaaaggagtgtattaatatgggaccggtccggattacagaagccgacagcttcttctttgaacggcaaaaactgccgctgcctcattttaccgctgaagattatctggcaagactggacctgctcaccggccggatgctcgaaaagggcgtcagccatgtcgtgatctacggtgatagggagcatttctccaacattgagtatttttccagttatgattgccgctttgaggaggccctgctggtggtggataaggagggcggacgttggatcattgtcggcaatgaagggatgggatacagctaccaaatcccctatccgatcaaccggatgctctgccagcacttcagtctccaggggcagcctcgcgacagcagtctcgcgcttgaaaagttgttggaacagactgggatccggcggggaagccgcgtcggtgtggtaggatataaatatttttatcctacgtacaccgccgatccgctgcacagctttgacgtgccgatgtatatgatggaggcgatctttgcggcggcgggccgggagaatgtggagaatttcaccagtgagatcactggactgccggacggcatccggatgcgggtttatacgccaaaagagatcgcctgggcggaatacagcgcgacaaaatccgccgatgtgttgctcaacctatttgacgcgctcgaggtcggcgggcaggagctggaaacctcccgctatgggaaaatcgatttcacaccggtgtgtatgtacagccttgtcaattttggagcgttcaacctttcgctcggcctgcgcagcccagatgacagcattttgaacttgggagatccctgcgggctttgctacggcgcccgagggagtctgacctcccgtactgggatcgcagcaagcagtggggacgactggccgcgggcgctcgcggaggagctggaaaatttctatatgccgttttggtccgcgatcgccgcatggtatgaaaccattcgggttgggacgaccggcggcgcgctttacgacgcggttatgaaaataataggcggtcccgagttcggcgtcgccctcaatcccggtcacaacacagggatggatgaatggacgaattctcccgtttatcgaggctccacgctgccggttttgagcggcgcctatatgcagtgcgacatcattgcgtcgcggcaggagccgtatttccataacgcgatctgtgaggataccgttatcatcgcggacgagacgctgcgtgccgggattgcagcgcaatatcctgaaatgcacgcccgcattcgggcacggcaggagaagatgcgttcggcgcttggcatccggctggatgacagcgtcctgccgatgagtaacctcaacggcgtatattttccctttatgctggatatatcccgcgtttttgccaaataaggcgcgggcctatttaaaaattcaggaggtagctatgaaaaagtttttgtgtggattgtttgcatttgtcctctctgcatccctgctggccgggtgccagtcgcccgccccaacggataccgctgcttcggccagtaccgcgtctctgggcgatacacaggcaaaccagccggaggacggccggattaaaattggagtttcctttgcatccgaggcgcagtaccgttttaaattcgataaacagattatggagcagaaggcggaggagctgggcgccgacattatcttccagtatgcgaactacgacgcaaccaaacaggccaatcaggttgaaaatctgatctcccaggggattgacgtgctggttctgaatgtggtaagcggcaatatggtaaaccttgtggaaaaggtacgcagccaaggcatcccggtcattacctttgacaacacggtcgagggcgcgcaggtcgacttgaatgtggaccgggacaatgtgaaggttgggcggctccagcttgaagcggctcttgaatatatgggaccggagggcggcaacgtcgtgctggtcaagggagaccccggcagcgcggtggcacagcggatcagccagggctatgaggctgtcgcggcggagcacccggagctgaacattgtggctgatcagttccatgaggcgtggagtcctgataaggcactcaaaaccgtcgaaaatgcgctctctgcaaacaacgatgatattcaagcgtttgtcgcgtccgccgactcggtcgctttgggcatcgttcctgcgatcaaagcagcgaagctggacggcaaagcgttcctctgcgggatggatgtggagatctccgccgccaagctcatcaatgagggcgttatgaccatgagcatttggactgatattgtctccggcgaccagcgcacgatcgaggccgcggttaaactgggcaagggtgaggaaatcacgcccgacgagatccagcagatcggcgggtttgacattccagtccttttggtggacgttatgcccgtcacaaaggataatttgcgccagtggctggatgagatcgctcccgccgggtgggcaaccgaggaggagatcttcggctgaccgtgagatatcataaaaacgctctgatttgaccgtttaacgcggggccttccggccccgctattataaagcaaaaaagggggcggcattttgccgaatgcagtattagagatccgcgggctgaccaaacgcttcccctccgtccttgcggtcgaccgggctaccctgtcgattgagccgggcaaggtccatgcgattgtcggtggaaacggcgccggaaaatccacgctgatgaaaatgctttcaggcgtttatccatatgggagctacgaaggagaattttttgtggatggacggccctgccggtttcgatcgattatggacgcggaagccaatggcatttcgatggtcccgcaggatttaaacatggtcaacgagatgacggttgcagacaatctgtttatcaatcgccagccgggacgtgcagggctggttaaccaagctgttatgatgcgcagagcgcaggagatcatcgacgactttgggctgcatatcaaccccaacagcctggtcaaggagatcggtatcgcacaaaagcagcttattgtgatcgcccgtgcgatgcacaatcaggtcaaagcattgattttggacgagccgaccgccacgctttccagtgaggaaagcgagctgctgtttgccaaggtgcgggagctgcgcggcaaagggatcgcctgtatctatatctcccaccgtctggaggaggtacagagtttgtcggacacgattacagtcatgcgcgatggacggatcattgaaaccgatgcggttgagcgcatggacgagcggcggatcgtttcgctgatggtcggccgggatgtggacgatttctatcctccgcgtacgaacaagcccggcgatgtggttttccgcgcaaaaggcgttacggtttacaaccagaaattcccggataaaaaggtggtcgacaatgtggcgttcgacctgcgctccggcgaaatccttgcggtctatgggctggtcggctcggggcgcaccgagatggcgatggggatgatcggcgcttggaagggcaacgtcgaatgtgaggttgaggtcaagggcaaggccgttgtaagccgcaaccccgcgcaagcgctcaaaaacggcatcagcctgctgcctgaggaccgcaagcgggaaggtgcgatcgccaggcagtccgtagggagcaacatctccgcctcgagcctgccgcgcttttcaaaattcggtgtgataaacagcctgctggaaaagcagaacaaccaggggatgatccgctccatgtccatcaagaccccgtcgatggacgctctgatcgaaacgctgagcggcggcaatcagcagaaggttattctgtcgcggctgatctcggctgattcgccggttttgattctggatgaggcgacgcagggggtcgatgtggaagcaaaaacacagatctacaatattctgaacaatcttacagcacagggcaaggctatcttgtttatctcgtctgacattgcggaagtgatggggattgccgaccggatcatggtaatccgccacggcagagtagtcaaaattcttgataatcaggctctcgataaggagcaggtgctttggtatgcgacggtcggagatgaaggaggaaaataaatggctggcagagatatcaaatccattttaaccggcaaagctggcaagaatatcgtgatggcggccggagtcatcatcctgatgtgtatctttaatctgttaaccggcaacattttcacttccgtgcgaaatcttacgctgctgatgaagcagggttcggtacttatgattgtggcgtcagggctgatgctgctgctgatcgaacgcaattttgacctgagcggcggcgctgcggtctattttgtcagcgtgattgcggcccagtgtgccgttacctataaactcccgctgcccttcgccctgctgattgcgatgctctgcggcctgctcatgggcgcactcaatggttttttcatcggctatgtgggtatccctgcgtttatcggtacgctggccgcacagcttttgttcaaaggggtcggctacacatggaccaatgcggcgacgattggtccgctttcagacgagtttgcatggctgagcgagggatacatcccacccgccgcgagcgcggttttaattgtggcggttgcattggccgcctgcctgttctgcattttcgactataaaaaaatgcgccagtggtatggcagtgtcaaccgcctgttcacccgcatcgcagcgattgtaattgccgcagttctggcaatttggatcttcaccggctattacggcataccgatgtgcgtgttttttgcgggggtgatggcctcgattacggggtttatctccaacaagaccgtatttggacggcatatttacatcatcggcggaaatccggaggcggcaaatctttcgggaattaagacaaagcgccgcatctttcagtcatatgtctatatgggtgtgatctatggtgtagcgggcattgtgattaccgcgcggctgggcggctccaccgctacctccggaaacctgctcgagctggacgccgttgcggcggcctgtatcggcgggacgagcatgtccggcggcgtcggccggatcaccggcgttgcgctgggcgtgctggtgctttccgctgtggacaatgtgatgagtttgatgaacgtctcctcgtatttgcagatggtggtcaagggcttaatcctgcttctggcagtctgtatggacgtctgtatgaaccaaaccaaattccgcctgaagaaggccaaataaataataaacagagggaaagatatgaaaattgctgtcggcttattttatctggaatgcaacacctttaaccccgatctggttggacgggagcagtttatcttcgccgaaggccagcaggtgctcccctatctgcatgtatgtgatatcttccaagaggagggttttgagctggtgccaaccattatggcctccacactgcctgccggacggctaaaagaggacgatttctggttttttgccaataagattttgaatactgtgagggcaacccctgatctggacggcatctttctgcacctgcatggttcgatggaggtcgaaaacattggctccggagatctgcggcttgtgaaggagctgcggcggattgttggggacagcctgccgatcggcatcgcgctcgatgcgcatgccaacaacgacgcgtcccttgccgattatgtaaacatgatacgtggataccatacgattcctcattcggaccagccggaaaccgaacaggcggtagcgcgcgcgctggtgaaatttatccgggaaaagcggcggatcaaacctgcgcttaccattgtacccgcgatcatctcgggagaaaaagggctttctgccgtcgaaccgctcaaaggtctgattgaaaaagcagaagcttacgaacagatggaaggaattgaaagcgcaaccgtctttatgggcgatccgtggtcagactgtccaaacagtcatctttcggtcgtcgtggttcccgagcgggaggaatatagcgaaaaggcccgtgcgctttcacgggagctggcgcaggaaatgcttgatttgcgccgtcagtttgactttgaggtaccggcgttgcgtccgcccgaggcgcttgcatgcgcgctggcgtttgaaggcgggcaggtattcatcaccgactcgggtgataacacaaccggcggggcggtgggtgaaggcaccgagatgctccgtctgatcacggcctgccccgatttaaagggtaaaaaggttttgattgccgcgatccatgatgacgctgcgtttgcagcctgtatgcaggtggaaatcggccagccggtttcgctggcggttggcaccggacgggatgaaacttccatttcgaccaaaatttccggagtgctcaaatgccgcggcaaggtgcttggctatctcaataccgacagcgacgagtgcgggtcctgctgtacggtgtcgctgggtgcggtggatgttgtgatctccaacgcggcgacttcttttattacgccgggacattttgaggccgcgggaacgccgctcgatcattatgacattttggtcatcaagcaggggtatctgtttgcgcagctcagaccgtttgccaaattggcgatgatggcggttacaaagggcgccacctatcaatttattgaagaactgccgtacaagcatcttatgcatcccatctttccgtttgaggatgctcataaaatccagtctatggcgaatgaaaactgaatcgcagcttatttcaaagcgaagccgttgtatctacagcctaaaaagccgcaggcagggcatgaatgccctgcctgcggcttttttgtagctttagcgaaagaaatcaaccagctatgctggtaagaatagaaatcttaagatacaagaaatcctccttttgctaaaatagatgagggtttgccggccgcatcaaggcaaaaggagaatattgtcatgaaagacgtaaagacttgtgcaaaccacgcgttctacgcgtggttttgatttatgaagcggttgattatgcgatgcctgataactgtctaacgactcccgtttaaagcaatcaacttctcgataatcttttcccgatattctgtatgacgcggcatacctttgcctaaaccgcctcgctttggaaactggagcttgaggaaaccgccgttcttcaacgtgatcgaacagttgacagctcccataatagcgttttttatctcacagctttgaatatctgccagcggaaaacaaacgccaatatcttctgccacggtccttcttaagtctggcacgtgatagaactcatttaaatacttgcgtttttcacattcagatactatcaaatagtcttttgtgataccaatatatacatcaaatcttgatgtttttttttgtttacttgaagcgtaacaccatgtatacctgccgtaagcgtttcgccgttgggaatgcatgtttccaaaacctgtatcattctgtgctcgtcaaaaatgccattcaaaagattctcctccagttaaagatttgatgatgagtttgtctgtcccattttaacataactttattaatatgaaaagaatatgccttttaaaagatagtcctttttgcggagatgcggtacaggcatatttctaaatttagcaaagattctttttgatgattgtaaaatttcccttgacggaaatattcaaatcagataaaatggaaaaaaagaataatgagaatctcgagcaaaatagcctaaaaagaggaagtttcttcatggccttttgcctggacccacggatgatcggtttatcacagcggtggtccacggggttgccgtagaaatgcggccgccttcacattttgaaaagagatcgacgaagcgttaaagagacggctttttagttgtgcgcagttatgcctggcggcaggcagccacaccggaaggctgtcttataccgtctgtttttgtgaaggctgccacagtttggtgtggcggccttttattgttataaagccgtttaatattgtataaggaggaggcgtccgccttggaaaaccagtttagtccgacatttgaaaaattgttatcccgcgaggaaatcatcgcttcggtgattcgcaactggactcccgaaagggtaattgaacagattcccgtaactgaagcgttaggacgtatcccatccgcaaaggtttgctctgtatggacacttccggtggttcgatcctctgctggggatggtattgctgttgattcgtcccggtttgcacaggggataccggatacctccggctggatacagggacgtgattttgtccacgccgatacaggggatgattttgacgatgcttttgacgcggtgataatggtcgaagatatcgcgttctccccagaagggcggctgacgatccgggatggggttcaagtgtatcctggatacaatgtgcgcccggcaggctctatcgtccaaaagggagaggcgctggtgagagccaatctccctttgcgtcccagggatttggcctgccttcagatgggcggcgtgggacagatctctgtttggaaaaagccggttgtggcctttatcccatcgggtagcgagctgattgctccaggcacgcctgtaacccgcggcaaaaatgtggatacaaacagcttgcttgtgcgtgagactataaaacagttgggggccgagcctctgtgccttccgatcgttccggatgactatgagcctattctggaggccctggacagcgccctcatcaaagccgacatcattattttgggaggcggatcctccaagggagcagaggacttttccgccaccctgctgcaccagcgtgggaaggtattgtgccatggcgcgcaggcggttcccggaaagccgctgtgtgtcgctatgatacagggaaagcctgtcatcaacctgcccggtccgttcatggcggcctatcatggactggagtggctggtcaatgccctggtttctcattttctgatgcagccaaagcaagcgcgccagactgtgaaagctacgctgacccaacctgtagagggcagcgaaagggtttccatgctgttggtggtagaggtaagccgaaaacgggatggatcgggctattgggcaacgccgtataattttaaaaagattccgatgagccgcacggttgcagcaaatggacaatatatgacgaaactgggggaatcgctgccggccggcagcgagatcgaggtggagctgctgcgtggtccggcatatattccagatgccggctgggattaaggggctgtttaaaaaataataattcccgccgccttctgtaaacagaggcgaaaaatttgtcaattgcgctattttcaaacaagccctagagagtgcctgaaaatcggggctgctttgattctcaaagaatttcgaaaccagggagggtcctgcggtgctgaccgtaaattcaaacacgatgcagagaattccggagggatatgaatttgactggatcgctcaaaacatcttttttcctatttatccggttattgtggatgatattctggcccgtattccccgccgggacggtgttttgattgatgtgggctgtgggagcgggcatctggggctggcgcttctggaacggacacggtataaaggctgcttgattgatatcaatcaaacggcgttggaactgggccgtgctcacgcgcgggaacggggactggctgaccgggcagtatttatgcggcaggatgtgcattccatggactttccggatggatacgccgatctgattatcagccgtggctcttatcatttttgggcagatttggagaaggctctgacagagatataccgggtattggctccgggcggcaatacatatatcggaggcggaatgggaagcgcggcgttggcagaatccatccgtccgcagatgcaggctgttatgccggggtggcccgatgggccgctgcaacgcagcggtaaaatatcgacagaatatttgaacacttttttggagcgccagagcatccctcatgaaatcgtagaaaaccaggagcagggacgctggatcattatgcataaatagcatggattcggggtgtattatgtcggaaaattggaaggaaaagtgggctgcggcatggccggttctgctggttttgcctatactggcgtttgtgttctcatttggtgttggacgattctccatttcgccgtcggagctgctgcacacattgttttatcattttgcagatcccagtcaaattgtcgattccaatatggaaaccacgctgttcaatatccggctgcctcgtatattggcggtattgctggtggggggcggactatctatcgctggcgcggcttatcaggggatgtttaaaaatccaatggtatcgccggatattttgggggcctccgctggagccggatttggggcttgtttggctatgttgatggagctgcctactgtgtatgtccagatgttcagcttttgtggaggtattttggcggtattcatagcggccacagccacgcgccggttcagcatggacccgattctgggattggtgctgggcggtatgatggtaagcaccctgttccagtccggaacatccaccatcaagattttagccgatgcggacaacaagcttccgcagatcaccttttggctgatgggaagctttaatgtcatgaacaaggcaaagctgttcagcattttaattcctatcggagcaggctttttaattctttttctggttcgctggcagctcaacgtcctttcatttggggaggatgaggccagcagcctgggaattaaaacgaaacgtatacgcagtatggtcatcatcgcctccacgctgatcactgcttcctgtgtttccgtgtgcggcatggtgggctgggtcgggctggtcatcccgcatgcgggccgggccttggcgggaccggactaccgccgcttgctcccggtttgcgcaatattaggctccacctttctgctgcttgtagatgatgtcgcgcgtaccgcctttatggtagaactacccatcggtattttgacctcattcattggcgtaccgttttttatgttcattttcaagtcgggcgtcaataaaggaggcagcgcatgatccaggtaagggatgttgaattcagctatggaaagcaagaggttctcaagggaatttctttttgtatggagaagggagagtttgtttgtgtgctgggcgccaatgggtgcggaaaaacaacgctgctcaaaagcatcctggcttttttaactcctcagcatgggcaggtgctgctttatggaaaggatattcaccagatggatgagcgtgaacgggcgcgaaagattgcgtatattccacaatatcatacgccgccgtttccgtttactgttcgcgacgtggtgctcatgggacgcacaccgcacctcagccgtatatgccgccccactgagaaagactgccggatagccgatgaatccatggaacgtttgggcatcgctcattatgcaaacaaatcctacactgctctttccggcgggcagagacaaatggtcgtcattgccagagccttagcacagcagcctgatcttttgattatggatgaacccacggccagtcttgattttggaaatcagtacttggtattggcgcaggttaaaaagctggcaagggagggaatgggggtgttgatggtaacacacaatcccgaccacgctttctactgtgccgaccgcatcatcgccatggaagatggaaaaatcctttcaatgggcgacgcaggaaaggtgataaatgaagcagtcatgaaggccgtctaccatatgccggtcaaggtacgcagcgtttctttgggagagggacttgacgctacgatttgtatccctgtcccggatttatcgccgggccgcccggccggattttacggggcaagcggcctgaggtgcgaaccttcagccaattgagcgaacaaacagatcaatacgtaaaggagattgaaacaaaccatgaaacgaagtctgtccaaaccgctgctcctgttggcacttgccgcctcactcatgctctcagcgtgcagccagcagccggattcggcgtcaagttcctccgcggccgttcccgcatcgtcggcgaacgcatccgcagcgagccagccaagcagcgataccgtggaaattgtggatatgggcggccgcaccgttaccatcccttccccggaaaatctgatccgcatgtatccggatggttccacatctatgattctgctctatacattggcgcctgataaaatgactgccgcgccaagtcagacaggcagtgctttcagcgacgatcaaaagccctttgtcatgcctgaggtgtgggatcttcccagctatgggactttatccggcaaaggttccttgaacctggaggcgattaaggccgctgatgtacaggtgattctcagcatgggtacaagcgccatcactgacgccgatattacaaccgctgacgagttacaggcacaacttgaaatcccggtggtgctgttcagcggcgacagcgaggattatgcgcaggcatacaggcttctgggtaagatgattgaccgggaggaggacgcggaggctctgattaattataccgcggatatcgtaaagacggttgaatctgtggcagcccaggtaccggaggaagaccgggtgcgactttactacgctgagggcgacgacggtctggctaccgagccggcaagttctaaccgctcctatgtgtttaatactgccggcgctgtcaatgtggctgatgtgggtgcacaggcgggctatgggcagtccgccgtgtccatggagcaggtactggagtggaatccggagatcattattacacaggggacgacaaacgcttatgagacaatcctgagcgaccccaattgggcgacgattgatgcggtaaaaaacggacgcgtatacaaaatgcccagtctgccctatagctgggccgaccgaccgccctctgtcaatcgattcattgggcttcactggatggcgaatctgctctatccagagctatatgatatcgatatcgtggaagtggcgattgactattacaaagtcatgtatcatgtggatgtttcccgaacggatatggagtccttgctggcccaatccatcccacaggagtgatttttcttttatcagcctgcaaaacaacatgggcgtatttgcgcgctgttccacaatcaacgcgccttatataaggcgtcgatgaacccatcgcgtgcggagcaacagaaacagagtaaaaagccagcgccgtttaggcgctggcttttgctgtctatactttgtatgtgggacagacctgaatcaaacaaggccctgtgccatcatggcattggcaaccttgaggaacgcggccacgttggcgccggaaacgtaatcctcaggcgtcttaccgtattcagcggcggcggaggacatgctcttgtagatatccttcatgatattctgcaaccgctgatcgacgtcctcaaagctccaggagagacgcaggctgttctggctcatttccaaagcggaaacggcgacaccgccggcattagcggccttgctgggcacaaacaggattcccgcttcaatgaaagcgtccatggcctccagtgtggacggcatattagcgccctcgcaaaccatccagcaaccgtttttcaacaggctcttggcagcgtccaaatcgatctcgttctgggtcgcgcagggcagaacaatatcgcagggaacactccagatcccttggaagccctcgtggtattctgcggaaggacgggccttgatatattccttaattctggcgcggcgaacctccttgatatcctgaataacagagatgtcaacgccgtccttgtcatagatatagccgttggaatcacacatagcgatgacggtggcgcccaaagaaatggctttttccgctgcatagatcgccacattaccggaaccggaaaccactactttctgcccttggaagctcttgcccttatgagtgagaatttcatttgccaggtaaaccacgccgtagccggtggcctgtgtacgggccagggaaccaccatatgtaaggccctttccggtaagaacgccggaatactcgccggtgatgcgtttatactggccatagagataaccgatttcacgtccgcccacgccgatgtcgcccgcgggaacatcgcagtccgggccgatgtggcggtaaagttcggtcatgaagctctgacagaaacgcatgacctcgtcgtcgcttttgcccttcggatcaaagtcactgccgcctttgccgccgccgatgggcagaccagtgagggagtttttaaagatctgctcaaagccgaggaatttcaggatgccctgattgacgctcggatgaaagcgcaggccacccttataggggccgatcgcactgttgaactggacgcggtatccccggttgatctgatactcgcccttgtcgtcgacccacggaacacggaagctgacgatgcgctccggttcgacaaggcgttcaagcagcttggccttctgatattcgggatggcgctccaagacgccgcgcagggagttgagaacctcggtggttgtttgaagaaattcaggctcatgcgcgtttttttccttgaccgaagccaagacctgatcaacatagctcattgataagacccctccaaaataaatttttgtcgaaaaacggtatacctgcgggggccgcggccgggtattatactaccggagacgatatgcagaaaagacgacaggaaacgaacttctccacttcatatcgagccgcgcccgggcttgcattacatactaattatactgtctaaccggggggctgtgtcaataggttttgccaaaaaaatatatttttttgcatgtatccgaataaagtgctgcaaaaaatggtctttttactccggaaaaatggcttttttacatggaatcaatttgaggtcgtcaaaattataaaaaatttctaattattggaatttgagacatctgatcaaacacccctgaaatgtgcgccaaatttcatatgggcaaaaaagaaagggacgccggatgcgtccctttttatcgatgaccgcctttcttcatcagacggcttgtttggtttgtaatttacatcctgctgagttcacaggcgatctgtgtggcaacctttgcgttgttgtagacgagctggatgttcgccttgaggctcgaaccgccggtgattttctcaagcttatcgagcaggaacggcgtggtatccttgcccttgatccccttggcgtttgcctcgtcgatggcttctgcgatcgatttggagatgtagtcggcgtccatcgcatactcctcggggatcggattggcgacaaccatgccgccgcgcaggccaagatcattttttgccttaaaggcagccgcaagctccttcggagtatccatacggtagtcaaccttgaagccgctcttgcgggtgaagaaggcgggcagctcctcggtctgatatccaaggacggagacgccgtgcgtttcaaggtattcgagcgtcaggccgagatcaaggatcgatttggcgccggcgcagataaccataacaggagtggaggcaagctcctcaaggtcggcggagatatccattgtcgtttcagcgccgcggtggacgccgccgataccgccggtcgcaaaaacagaaacgcctgcaagattggcaagaatcatggtggcggcgactgttgtagcgccgtcctcgccgcgcgcgaccagcacaggaatatcacggcggctggccttggtgaccttcaggccctttttgccgatataatcaatttcgtccttggaaaggccgacacgcagtttgccgccgatgatcgccgtggtagccggaaccgcgccgttgtcgcggatgatcttttcaacattcagcgccgtttcgacgttctgcggatacggcatgccgtgggagatgatggtggattcaagcgcgacgaccggacggccttcgtcaagggccttctggacttcgggcgaaatttcgaggtattttttcagatctgtcatgacaatacactcctttttaaaatatatatgaatgtggatggatagacggtatttattccgcttcctcgggcggcatcatcccgataatatcatagatcgccttggcgctgatgcgcgggctgatggtttcctcgcttgcgatacagatgcttgcggcggccaggccggcgcgggcggtatcctccaatgaaagtccctgccgccatccccaggcaagcgccgccataaagctgtcgccagcgccggtcgtgttgaccgattcagaagcataacaaggcagaagcgcctgcccatggtgattggcacaaaagacgccatcgccgccaagcgagataaagacctgctcaagtcccatgtcaagcagcttttttgccgcgcgccgcaaggagctttcatcggtgatctcgatcctggtgagaagctgcgcctccagcttattgggcttgagcgtatgaatgtgatagagcagccccgcgagctttttggcctttgttgtggaaacggtgtccgcaaagagcgggcagcggcaattttccgcgagatagcgcagcgattcggaagaaaggtttgtatcgacaatgcacaggcttgcgcggttgataaaatcgatttttgtttccaaaaatttaggcgtgatctgattatagatgtccatgtcagcaatggccagcatcatatcgccgtgctcgtctgtaatgaacatatatgtagaggtgacgccgccggggactgtcagcgagttggaaatatccatgccgaccctgcggcatccctcggcaagctgtgcggcatgagcgtcctcgccgaacgcagatataaacttgacgtcctccccgagaagggccaggttgtgtgcgatattgcgtgcaacgccgccggcggagaggctgacgtgaccggggttggaatccttctggaccagcggtgcgtccggatgtccgaagatatccatattgactccgccgattacaacgatatagggatttttctgaaggatgtagcccttgccctgaatcaacccttttttcatcaggttggaaatgtgcacggccaccgacgaacgggtgatgttgccaagctcggcaagctcctgctgtgagatcagcggattttcttcgatccagcgcaggatctgacgctcacgctccgtaatcattaggtcgcctccttggttttaacaattgcttataataataatcttatgcttataatatatcatgcgcatattggattgtcaataggtataagagaaaaatacaaacaaaatcatgcctgtatttttggctataatatgaaaaccggtcggctcacagatgggaatctgtgagccgaccggtttgtgacgccaacttattttattggacggcttttttcatagcggcgacgccgtcgtttgtcatgcgttttgcaatgttgtcgcgtatataggcctgattttcaaggtattggttgaatgcgatgcggtcagcttctgtagacaggaccgataaatcacggcacgcctcaaaaaacacacggttgacgcgatagatttcttcaagcgtctcagcataaaccttggtatggcgcttgttgctgccacacgcatcccgaagctgcgtcaagacatgcagcatcgtttcatgccgttctttacaatagtcgtccgcgccgcgtgcaagaatccgttggatggcggccggctgctcatgcaggggaagcggtaaactgtgctcatcacaggcaagtttacagtcggggttcgtttgaccgatggcatataccgccgcttctgtgaacgcaaggccaaatgggtcgcaaatccggcgcaggcgctgatgctgccgggaggtcatgacaaaactggccgccacaaaaagcagcataagtccatatgcgatcagataattggtatccatcagcacgtacccccattcaaagtatggatattcattttcaacaaaacagctatcaaaaatataacataaatcggatgaatcgtccagtaaggatatggaaaaggcgcctctccattgcagagaaagcgccctgtaggtgttttatcagacgacaccgaccgtcagaataatacaggcgtatgtgcgtttttcgccggtcgagatcgccaggcggacctttggctcattggccttgctgtaaaatccccagcgatcgatggtttccagctttacaccgtcaagcagctcgcggaaatccttgaagatcggcggctctgtgccgtcgcccggggtcatgacaagcgcgctttcaatgccgatcgtttcagacagaactttgagcgtgtcggttacggtcgggataccggcagtcaggccgagataaacctttttcgcatcaccgctctctgcgtcaagcggatagttgccgtcggcgatcaggattttgtcgccgtgaccgcacagcgagatggccttcataatttcgggattgatacatgcgtttttcagcatagcagatgctcctaaccttacaaaatttacttttcgttttcgcgcagttggccgagcgttccgcccggatgccatttgacatactcctttggatcaaggccgcggttgacctggagaagaacgctcaaccgctggaggacaaatgtctctgcaaggatcgatgcgcgcggcgcgcgattgagcgggccgccctcctgccgcacaccggcgaacaggtgcgcatcgctttccctggcgagccaagatgtgcggtttccggtgattccaatcactttgcagccattgcgcttgatagcggtaactgtcgttttcatttccgccgtttccccgctgtttgaaatgcagatgacaacgtcgcccgcggcaagctgtccgcaggaaccgtgcaccgcttccgtgccatggaggaaatacgtcggcgtgccggtagaggacatcagcgacgcgccgtatccgctgacatggcccggttttccgatgccggtgatatgcacgcggccgccctttgcctgcgcgtccagaataagctgcgcggcgtcgatgtattcctgatcggcggcattgtccacaaaatggtcaaattcggccttggccagggaggtaaacgcttccatagcctgaatagcttcctgtttcagcatgggatcaatctccttttcgtctgtggaatgcaatttcatttcaggatatcaagcagccccaggtcgaacccatcaaactgttcgcgctgcatcagctcaatcacatcggccagatgcggcagggacggctgcgcgcccatctgtgaaacggtgattgtcgcggtatagtttgcaaagtcgagcgcctgccgctggttcagtccggcgcaaacggctgtgcaaaatgcgccgacaaacgaatcacccgcggcggttgggtccttgacctccaccacatcgacacatgggctgaagtcgatgccgctgtctccggccacgaccgcgccggcactgccgagcgtaataatgacgttctgaacgcccttgccgcgcagagaggcgatgacagcgtcgagatcatcgcggttgacggacttgccctccttgcggatcggaatgccggtaaggtccgccgcctcgtgctcattgggcgatatgtatgtcaggtgtgaaagcagtgcggctgaaagcggcgcgctcggcgcggaattaagcatcacggggacgcccttttcaaaggcgtactgtgcgaccagctcattgatctgcatcggaatttcaagctggagcatcaccatatcgaattcggagacgatgtcgcgtacaaacgcgacgtcgtccggagtgattgccatattggcgcctgaaacgacgataatgcggtttttgcttttctggccctctgcgacctccagcaggatattcccgattgccgacggattgtccgggtcctgaaggatatgctgcgtgtggatgccggccgcctgcgcggaagcgatcagctcacggccaaagctgtcgccgccgaccttgccgaccattgtgacgtccgcgccaagccgcgctgcctgcacggcctggtttgcgccctttccgcccggcgctgtccgaaagcttttgccaagcacggtttcgccggaaccgggaaatttttcggtggaaacaatcagatccatgacgaaactgccaaccaccaggatttttggtttcctgttcatacaatatctcctttattatatcatgttggatgccgtttgcctatagggtatcaggaccgcgtgtgccgccgtgtgactggcggacggcaagcgcagagggaaggacggcgaccgccggatcaggcgtattgcccgcaagcaactcaataagcatgcgtgcgcccagcgcgcccataccgcgcgcatcctggcgcacagccgtgatcggcggggagacgatctgtgtccagtcgtaatcgtcaaatccgacgagcgcaatttgttcagggatgcggatcccctgttcgttgagatattggacaacgcccatcgtcagaacgctgtttgcggcaaatatagcgtcggccccgtaccgcacaagggaacgggccgcattgcgcgcgctttccaggctgtaatcaagctcataggcgatcaggctgaagtcgtgcgcaagccccagcgccgcaagcgccttttgataaccgcggtaacggtcatacgcggaggaaaaatcgagcgtgcccccgatatagccgatgcgccgccggccgctttgcgccaagagttctatggcacgcacagcggcctgttcgttatcggaaccgacaaaaggcaggctgacgccgtcaaggcggcggtcgatcagaacgaccgggacatcaacgccggtcagacattcggcgcgccgtcggctgcccgggacaaacagcacgccgtcaatccagttcttttgcaggacggggatgccgccgagaagaaaatgcgggtcattttcagaataagtggaaacgatcagatcgtagccctgttcctgtagcgtttgcttaacgccgccaagcacatcgaaaaaaaagcaattggtggagttatttggctccgtggaagggatgatgagcgcgatcatattggtgcgctgcgttttaagcgcctgtgcggcgccgttggggcggtagccggttttagcgactgcatcgcggatgagcgccatactcttttgcgagacagcgcgcgtcccattgagcgcatgagaaacggtggtgatcgacagcccggtcatacgggcgatttccttcagccccataagaagctcctttatagtaagaggcagttgcatgaaattgataaaacgtttgcgcgcaaacgttttacataagataagaataccaccgaaaagcaggagaagtcaagctttatacaatcgtgaaaggtgacaaatatttaattgttttttatacattaaccccaaaaaaccaattattagttaaaaatttatggaaagggcttgcaaattaagaacattatgttaatatacctgtagtataggtgaacagatttcggaaacgcaaagtgatcagcagatttaatttttcatcgcgattaaaaaacgccgagctgcttcaccgcaaataacaaggaggaaaagaaatgaaaaagattctcgcttctatgctgtcggctgcaatcgtttcggccatgctgcttacaggctgcggttcatccggcagcgcgccggcagccgacgcatccgccgccggctccacccccgccgcggacaataccggaggcacggcgaccgactatccgaccaaacagatcagtatgattatccaggcatcccccggcggtctgtccgatacgaacgcgcgcgccatcgcgcagcttgttcaggaggatttgggcgtgcctgtcgtatgcacaaacaaaccaggcgcctccggcgcggttgcaatgtcctttttgcaggcgagcaaaccggacggatatactatcggttatgtcccggttgagctgtcaatggtccaggcgcttggttatgcgacagatgtctatccggacgcgttcgacctgatttccggatgcaacacgcagcctgctgcgattaccgttcgcgctgattccggctggaacagcattgaggatcttgtcaattatgccaaggagaatcccggacaacttcgtgtcggaaactccggcacaggttccatctggcaggtcgccggcgattcttttgcaaacgcggcgggcatcgaggtcaaccaggtaccgtttgacggcgccgctccggcggtcgccggcctgatgggcaagcatatcgatatggtttccgtctctgaattcgaggtttcctccggcgtcgccagcggagagctgaaaattctggctgtctgttccgaggagcgcagcaaattcaatcccgatgtcccgacgctcaaagagcttggatacgacgtgaatgtcagcgcatggggcggcttcgcgcttccgaaggacaccccggacgatgtcaaggagatcctgtacgcttcgtttgaaaaggccgtcggatccgatagctatgccgagctgtgcgcaaagaatcagtattctccgatgcccctgaagcatgatgaatttgcggcgttcgccaatgagcagtatgagttctacaagagctattttgagcagaattccgtgacctgatccggttgccaggcgtattttcggaaacgggccggccgtgtgtcggccggcccgtttccattttcagcagctcctaatattgatagaaggtgatgttgcttggataaaaagacatccgcattcaatgccgatgtcgtcattggggtattcggtatccttctgagtgtctggtggattgtcatggcgctcggtttcccaggatccacagccaaggacggcacgccgggaccggcagttttcccaatcggtacagcggcgattttaattgttctgtctgtgctgatgattctggccgggctgaaaaataagacgacttattttaatttccgccagatggaccgcgacaacaagattgctctggcgctttcggttgtatgcttcattctgtttctcattctctggaattatgtccactacattgcggccagctttgtaatgtcctttggacttggcgtcctttatcggatgaagccggtcaaggctgccctgcttggcgcggttttcggcgcgggcacctattttttctttacaaaggtgctcatggtcatgcttgacatcgcacgataacaaaagggggctgcacatatggaattgctttggtcgacgctcgtcggcatttttacgacagatgttttcttttattgcctgctcggcgttgtggccggtatggtcatcggtacgctgcccggcctttccgccacgatgggtattgcgatcctcacgccgctgaccttctggctggagcctgcacagggcatggctgtcctgcttggcgtttataattcggccatctgggcgggcggtatttccgcgatcctgatcaatacgccgggaacgccggcgtccatcgcgcagacctttgacgggtatgcgcttgtcaaagaggggaaaattgccaaggcgctcaatatcaacacaatcttttcgtgtttcggcggacttgtcggtacgatcgtcctgattgtcgcgtcgtttccggttgcgcgctttgcgctcagcttcggccctccggagatgttcgcgctgtcctttttcggcctgtccatgatgatcggcgtttcgggtggaaacatcctgaaaggactgttcgccggaatcgccggcttcatgatctccaccatcggtcttgacccgatgttctccgtcccgcgctttacgtttggaaatgtcaatctgctttccggcgtccagttcgtcgttgtgctggtgggaatgtttggcgtcggcgaggtgctgtatcaggtaagcaaccgtgtcaaaggtgaacagacgcgcaaggctgagatcaagcgcgtgaagggcgacagccttctgacaaaaaaggaatggaaggactgtgcagttcccacggtgatttccgctctgatcagcgccgtgatcggcgcaattcccggaacaggcggcgatattgcatccattatctgctggcagcaggcaaagaacatgtccaaggacccggacagctatggcaagggaaatattaccgggctttgcgtcacctcctgtgcgaataatgcggtgatcggcggcgcgatgaccacaatgatgacgctcggcattccgggcgacggcgtaacggcggtgcttattggatcgctgatgatgtacggcatgcagcctggaccgcagatgttcgttgaacacgccgatttcgtgtacaacgtcatggcgctgatggtcgtcggctacatcatgattatgattcttggtcttgcttcttcaaagctggcgacgctgattctcaaggtaaagcaggaagtgatctgggtgatcgtcgtcggcttctgcgtccttggctcctatgcggtcaacaattcgatgttcgacgttatcgttatgttctttgcgggcatcatcggctttatctgcaaaaaagcggatatcccgcttggacccttcattctggcgttgctgctcggcccgattgccgagtcgaatttccgccgcagcatggcgctgtccatgggcgacgcgtcaattttcttcacgcgtccgatcacagttgtcctgctgctgctcacagccgcttcgctgatcgttccggttgtccgcgagggtatgaaacgcaaaaaaagccaggtccccgcttgacgctggatgatggtttcatttaaaatggatgtatggataagcgttgaaacgtcttaataggggaggacgatggtggtgaggacgctgcaaaacatcgattatgaagtgaaacgcgaaaatttatatgaaacagttgcggaaaagctggaggacagcattctcagcggcaacacgcaggtgggcgagcgcctgccgtccgagcaggcgctcgcggaaagctttggagtcagccgcaatgtgatgcgtgaatcgttaaagctgctcaaggaacgcggattgatcgattcgcgcatgggcggcggttcatacattacaaagccggaatcaagcgaccttgtgaatgttgtcaaccggattattctgatggacaacattgattatgaacaggtctttcaaatgcgcggcattttggagagcgccgcgtgtttgcttgcggctgtaaaatgtacgcagcagcaggtcgcacgtctggagatgatgaaccgtcaactgcgggaggccgctggcaatcaggaaaaaagcatgggaatcgatgtggattttcatgtggaaatcgcccggctgtcgggaaatccgctgctggaaatgttcgtggaggttatggcgcatccgctccgtcggggaatcgccgccggctacaatatcgatgatgggaaccgggacgcatttatgcgtcataacaacatcatacaggcgctcagcgagcatgatccgcataaagcgcatgccgctgcaatggaccatatcagccattcgctggataacatccgggaacgggaaaggatgaggatgcagtgatctttgattcgattgcaaatctggagaaataccgggagaaaattgcctgtgtcgatggtattttagcttttgttggcagggctgatcagttgaaaaccggccggtatgactttgacggaggctttgtgctggttcaggagggggtgacgcgtccgcctgaacaggcgcagtttgaagcgcacgatatttacgccgatttacagcttctttgcagaggcggcgagcgtgtggagtgggctgaccgcgccgtgctttcggagtccgtgccatatgatgcggacaaggatatcgctttttttcacggctccggcgtcgcgttcgatctcagaccgggcatgttttatgcggtttttccgcacgatgcgcataaacccagctgccatgtgggcggcgagcgccctgtgacttaccgcaagcttgtattcaagtttaaagtttaacaggacggcgggacatccgccatatatccggtccgttgtcaaagggtccggaaaaagattgggaggcaatcagtcatcatgaaaaagttatttggcgttaccacagctatgaccacgctgtttactgcggacggcgcgccgaatgtgcaggcgatgcgcgagctgacggacttcttgattgaaaaaggtgtgaactgcctgtatccgcttggtacgacgggcgaaatgcttcgcatgacggttgaggagcgcaagcttgtggccaaaacggtcgtcgagcaggccgctggacgctgcacagtattcattcatgttggagcgatgcgtcaggaggacgcgattgaactggccaaacatgcatacgaaatcggtgcggacggaatcggcgttgtttccccgcagttctttggagcgaacgaccgtgaaatcgaggaattttacgttgctgttgcggggagcgttccgcaggattatccggtctatctttacaatattccgcagtgcgcggccaacgatataaaaacatgtgtggcgcagaatgttgcaaaccgctgcaagaatgtaatcggcatcaaatacagctatcccgatttcatccgtacatatgagtatctcgaaatcaacggcggcgatttctccgtcatgcagggtcaggacaagatgtttttcccggcgttgatgatgggctgcgacggtacggtttccggcatctccggcgtgtatcccgagccgtttgtcgcggtctataaagcgtactgcgacggcgattacaagcgcgccaacgagcttcagcatgtctgcatcaagtattgcagcgcgctgcgcggcggcagcaatatggcgtatttcaaagaggcgctcaaaatgcgcggcttgaaatccggccacatgaaggcgccgcagcttgatctgacgcccgccgagattgaggagttgaaacacgatctcgacgcgatcccggaaaaatattgattcattcattgctcaattgaaaagcggtgcagtcgagggctgcaccgctttcgttttgattcaagccatggtataataaccgcagagcggttattataccgtcttatgcccaacggctcgccgcttgcgcggcaaccgcctttttatgaagaattatacgatgccagtcagaagggaatcgtcccgcccggatggggcggtttatgagggattatattttgatgaaatcgcggctggagatgggcatcaagccggcgcttggaatgaggtgttatttgttggactgcgacgctcttttagacatcgtctgcgatatcggctgcgagctgctcgaaagcggcgcggaaacgtaccgtgtggaggaatcggtttcccggattgtgcgtgcctttgccggcatggaggcgagtgtatttgccgtgccgacatgcgttattgtttccatcacacgaacaggcggcgggagtgaaacgaagacgaggcgtatctatgcgcggggaacgaatctcgaccgtgttgagcggctcaatgacctttgccgccgtatttgcagaggagaacttgagattgggcaggcgcgcagtgcgcttgaggagattcgtaatcaggacgcggccacaccgcgccgccgcatggcgggttttatcctgatcgcatttgggttcacgctgtttttcggcggggggctgtcggactcgctgtgcgcggctgtgatcggcgtggcggcgttttttgtctgtcttgttatgcagaggttggaagcgaacgctgtgtttatcaatattgtggcgggcggcgtaatcatgctgctggcggttggcgcggtatcggcaggtttggcgcaaaatgtcgataaaattgtgatcggtacattgatgaaccttgtcccgggcgttgcgctgaccaatgcgatgcgcgacattatggcgggcgattatctcgccggtcagacacgtatgacagaggcgctgcttgtggcgactgcgattgcactcggcgcgggcgcggcgctgatgctgacacgtttgctttgaggaggatgcttgatgaatatcctgcttccatgcctgtattcgtttataggatgcatcggttactgcctttcatttaacattcgtccgcgcaagcaaatgctgctgctttcttcagcaggcggcgcgttgggctggtgcgtctatctgctctgcggcggtataaaaaacgatattatccagtcattttttgccatcatagtggttgccgtctattcggaaattatggcgcgcctttataaagcgcccgcaacagtatatctggttgtggggctgatcccgcttgttccgggcggcggtatctattatacgatggagtattgtatcaatggcgatatgatgaattttatgaacacaggcatccatacctttggaattgcgggtgcgctgtcaattggcatcctgctcgtttccggcggtgtacgcctgcttaatgtcgtcggccgcctgcgcagaggtaatgggggacaggattgaaaacggtccccggctttttagccggggaccgtttttggcagcgccggactagtcggccccttcagcgcggccgcttcctctgcgcgcaggacacctgtttcatagtcaagctcaggcatatttgcccagaaacgcttggccatatgcgtcatacgacacttgggattatagcggccttcgacggcaatggatcggtagtaatgccgccacaggtcgcgaaaacggcgctcggtgtcgtcagcgggaggtaaggtcagatcgtccaccggacggatgaccgacgcatacgggcggtaaaaaagtgcaagcccatgtgtgcggtcaaagatcataaaggtttcctcgggaaagcgcgcggaaaaatgtgcgcccatctcggcgagtacgatggactttggatcgatcacgcagacaagcgcgccgccaaaatctgaaaaacgagcaaattcgatcagcagatgcgcttcattgcgctgcgcgcgcacaaggcgaaaaagcgccgccgtgctgtgctctgacagcaggtccgtgacagcggagccatattggtatgcagcgcggataaaatcgaatatgacgcgttcgcgcccggcggcgcaggaattccagccgtcgcgtatccagccgcatacctcgccgcccatgcgcacgagcgaacgccagacgcggtcggcgtgcgccgggacggctgcgatatcacgtattggaaaaagcgtcgcggcgtccggttccaatagttcggcgggccattcgcggcgcgtgtagctttcaaagacgcagcagagcagcccttcaaagctgccgtcgctgcggtatgcgggaccatggacaaacggcggacgcgaactgccgttttttacagttgaccggtcaggcattgggccacctccgttcggctgggaacgcggtcgaacagggaaagctgttccggagcatcgccgggaagggcggccagctcataatcgcgctctgagatcagcgcgcgcagcgcgctgtccggtgtaattttgacgccggcggccgcgcgtcctttgcataaaagaaaatattgcgcgcgtttgagaacgacgccgatgcggcgcaggccgtcgaaatcgaggcttgttcggcgccgcgccgcgacgatgcgctgcgcgcttttgacgccgatacccggcacgcgcagcagcagctcgtacggcgcggtattgacctcaacagggaattgctccatatggttcagcgcccagttgcatttgggatcgatcagagggttgaagctctgatgcgtttcatcaagcagttccgaggcttcaaagccataaaaacgcaggagccagtcggcctgataaagccggtgctcgcgcagcaaaggcggcttggtatcgatggaaggcagcagcgaatctgactgcaccggcatataggcggagaaaaaaacacgcttgagcgcatattttcgatagaggctctgtgtcagccgcaaaatctgaaaatccgtgtccggcgtcgcgccgatgatcatctgagtgctttgtccggccggtgcgaaacgcggcgcgctttgataacggacaagctcggccgagctttccgcgattgcgctgcggataaagcccatgggcctgagaatggaattttttgttttgtcaggtgcgagcttttctaggctttgatggcttggaagctcaatgttgacgctcatgcggtcggcgagcaggccgagcctgcggatgagcgcgtcgtccgcgccgggaatggccttgacatgtatatagccgccgaaccggtattcgccgcgcagcagcgagagcgtttcaatcagccgttcacaggtatagtcgggatttttgaggataccggacgaaaggaacagcccttcaatatagttgcggcggtagaactggatcgtcagctgtgcaagctcacgaggggaaaaagcggccctgcgcgtatcattgctgcgccggttcacacagtatttgcagtcataaatacatgcgtttgtcatgaggaccttcagcagtgaaatacagcgcccatccgctgcaaagctgtggcagagtccggccgtgacacagcttccaataccgccgcgcggcgcggcgcgcgatacgccggacgatgtgcaggccgcgtcgtatttggccgcgtccgacaggatctccagcttctccatcaggtccacatgtatgcctccctttttagaacatatgttcttttttcaggatatcatggagcacggttcttgtcaagcctgtaccggcggctgttttttctgtgccaaaatgatacaattggtttacagcgcgaaaatttggtaatataatagtaaattaggattgtatgccgggaaaagccagcccaaatggcggctttcaggctggtggctgtttgaaaaatcagaattcgcgtctttttctacaaacagcggcgaatgctgtgttaaaaagcctcggaatccgaaaggattcctgcgttttttgccttgtattcgcctgctgtttgcgaaaaatccggcaattcctgtattttttaaacaagctccaaagacaataaaaaggggttaaggacatgaagcagtatcaaattgacaaggaacaatttatcagtgatcttcaagggttgctgcgcattaaaagcgtccgcttcgactgtgggcctgaaacagaaaaggcgccgcttggacagggcatctatgacgcgatcgaatatatgctggatcttgggcgcaggtttggattccgcacaaaaaatgtggacggctactgcggctggattgaaatgggcgagggcgaccgtatggtcggcatcatcgcgcatgtcgataccgttcccgtggaatccgagggatggatcgcgccgccgtttgacggcacggtgatcgacggccgtatctatgggcgcggcacctccgacgacaaggggccggccatggttgcgctttatgctatgaaggctgtcgcggacagcggcgttaagctcgataagcgtgtgcgcctgatcctcggcggcgatgaggaggccggggagtggagctgcatgaagcggtaccgccagacagaggagctgccctcctgcgcgtttacacccgacgcggagtacccaacgacatacgctgaaaaagggattctccatgtgcgtatttcggcggcgcttgacgcgcaggtcaagccaattagcctgatctgtgaaaacgcatacaatgtcgtgccggcgtttgcaagcgcggtagtcgacggcgttcaatatgaggcgcagggcaaagcagcgcatgccatggcgcctgagcttggtgtgaacgcgcttctggggctgtgcggccagcttcgtgaaaaaggagttgaccatccgtttatcaagctttgcgggatagcgaatgcggaaggcttcgggatcgcattttcggatgaaccgtcggggaaactgacgatcaatccgtcgattgccaaagtggatgcgcagtcggccgagcttcgctgcgatatccgcattcccgtcacatttacagataagcaggttgtcgaggcgatcgcagagaaggtcgcgccgcttggattcacggtggaaaacgagtatttccagccgccgctttatgtagaaaaggattcgccgcttgttgcgacgcttcagcgcgtataccgggactgcacaggccgcgaggacgagcctgtatcaactggcggcggcacctatgcgcgcgcgtttgaaaacgcggtggcgttcggcgcgctttttccggacgaggaagtcacttatcataagacaaatgaaaattggaacgtcgaaaatatttggaaaaatcaccaaattatttcgaatgcaattgtcgcgctttaacaatgtttttgtttatttcgctaatgcattgctgcaatgctgcgcaattcctacagaaaaattccgaataatcatacttttccgacaaaaatggatattttattccaattgcgttggaagttacggaaaattgtggtatactgttaccgttgcaaatacaactgaccttgggcagcggtacggggaagcgccgtcttgggttatgttggcgctgtatgcggcgtgcaaaagggaaaagaaaaaggaagtggttgtttaatggaggagaagtccagcttcaagccgttcataccggcggagaaaattgttcccgaatttacggcgacatcgattgtaatcggtgtgattttggctgtgctgttcggcggcgcaaacgcctatctgggcctgcgtgtcggtatgacggtttcagcctcgattcccgcggctgttatctcaatgggaattatccgcgtcattctgcaccgcgaatcgattctggaaaataatatggttcaaacgatcggttccgccggtgaatcggtcgcggcgggcgcgatttttacattgcccgccatgttcatgtggatgaaggaatggggacagggcgcgccctccctcattgagatcgctttgatcgctctttgcggcggcgtcctcggcgttttgtttatggtgccgctgcgttcggcgctgattgtaaaggagcacggcgtgcttccctatccggaaggaaccgcctgcgccgaagtactgcttgccggtgaagaaggcggcgccaaagccggcaccgtgtttgccggcttgggaattgccgcgctgtataagttcattgcggacgggctgaagatcttcccgagcgaggtacactatgaagtgaccgcatataaaggctccggcatcggcatggatatcctgcccgcactggctggcgttggttatatctgcggaccgcgtatttcgtcctacatgctggcaggcggcgttacaagctggtttgtgctcatgccgctgatcgctctgtttggcattgatactgttctgttccctggagccgtgccgattgccgagatggattctttcgccatttggacaaattatatcaaatacatcggcgccggtgcggttgccgcgggcggcattatgagcctgatcaaatccctgccgctgattgtgcgcacctttgcacaggccatgggcagttatcgcaacaagaatgaatccagcgggcttcggacggaacaggatatgaatatggggattattctgattctgatcgttattacgattgtattcatctggctgtttccgccgattccggtcacattgatcggcgcggcctgtatcgcgatctttggtttcttttttgcaacggtatcgtcacggcttgttggcttggtcggctcatccaacaatccggtttccggcatggcgatcgccacgcttctcatttcaaccatcctgctcaaatcgacaggatcgtccggccagagcggtatgatgggcgcaatcgcgattggttctgtcatctgcatcatcgcggccatcgcgggcgatacgtctcaggatctcaaaaccggctacattgtcggcgccacgccgcgcaagcagcagtacggcgagctggtcggcgttgtcgcctctgcgattgcaatcggcggcgtgctctatctgcttgacagtgcatggggctatggttctacgatgctgcccgcgccgcaggccatgctgatgaagatggtcgttgagggcgttatggaggggaatctgccttggacacttgtctttgtaggcgttggcatcggcatcgctgttgaaatccttggaattcccgtactgccgtttgcagtcggcctttatttgccgatccacttgtccacaccgatcatggtcggcggcctgatccgtctctggttcgagaagcgtaagtttaaaagcgaaaaggcgcgtaaagcgacgatcgattcgggcgttttgtatatgtccggcatgatcgcaggcgaggggcttgtcggtatcctgctggcggtatttgcggtcatccctgtaaagaagcttatggatggcacgacgattaacttgggcaatgtaatcgatctttctgcgcgcggtatttcaattggacagattggcggtttggtcgtctttgcgctgcttctgctcacggttctcaagtttacgctctggcgcaaatccgaggaaaaataagaaaatgcaatagacgtcaggacggacgccgggtctgggacccggcgtccgctttcagtggaggtggagcgattgacaaagaaaacaagacgaatgacaaaaaattatctggattatatcccggtcaaaaatccggatatgccctggcggcaatccgacagcgggattgtgacggtgacggttacaaatactggtttttacaattggatcgcacagaaatttttccacaggccgcgacagagctacatcgatctggatcaatatggcagctttgtctggctgttgattgacggcgaacgcagtgtgtttgatatttccggggaagtggggctgcaatttgggaaaaaggcagatccgctgcttgaccggctggtaaagttttttgaaattctgaaggggcatggctttatctcctggaaggaaggtgcgcatgagcacgtttgaaatcattctttgggtgcttgcgtttgcggttgtaaccatgatcatctatggatggggccttgtcaaaagcagccgccagcaggacgatttgcttgcaatactttatcgtaaaggggaggccgcgatccgcagggcgcttaaaaagaaaggtcccatgacgcgcgcacagcttgaggaggggcttgccggcatccgtgcctccctgttttatacgaaaaaccgtgcggtggtccgtgatgcgcatacatttgccggacaactgcttgagtcaatgacgcaaagaggcgaattgcttctggacaatggaacataccggctcaacccggatagaaaaaagcggtgagaaacagttggtttctcaccgctttttaagattatgcaattctctgcgccagcagcttgccgatcagcacacccagaacacaaagcagaacgctgatgcatgcatacaaaataccaagggcgggacgcttttgctcgaacagcgtcacagtttccagcgaaaaggtggagaaggttgtaaaaccgccgcaaacacctgtttttaaaaacaaaataagtccgaaggggatgttcggttgatgttccgccaagccggtaacgaaaccgataacgaccgcgccaaacagattgatcaacagtgtggcgacaggaaaggggcctggaaacggaatcaagctgaacagataccggcagatcgctccaagcgctcctccggcgccaaccgccaaacaggtctgcatatccgttcctccctaaaaataatttcttttatcatagcatagagccgttcaattgtcacgcttaatcaatcgttccagtcctgtagcattcccgcagccttgcgaataggctaatagggggccatccacgaaggcccggaaaacctacacagatttggagaagataacatgtatgaatcaattatcccgctcaaccgcgtgcctgaaggagctattgcgcgtgtgaccgggctttttacaaccggagcgatgcgtcgcaggctccaggatatcggcctgattgaggggacggatatcgagtgccttcaaaaaagtccagccggcgatccgatcgcctattacatcaggggcgcggtgatcgcgctgcgttcagtggattcaggaaacatattggtacgctgtaatcaggctgtttaacaaattgtaaccaccatcagatataaggggcgattataaatgggtttgacatccgaatccacgggaaagcgggcgttggatgaggtattttccgttgtacgcggcgatggcgatacggttatagcgttggcgggcaatccgaacgtgggaaaaagcacagtgtttaatcaactgaccggcttaaagcagcataccggaaactggcccggcaaaaccgtaacgaacgcgcaggggcgctgcctgtaccatcaccgatcttttgtactggtcgatatacccggtacatattcgttgatggcgcattccgcagaggaggaggttgcacgcgattttatctgttttggcggggcggacgcggttattgtggtctgtgacgcgacttgcctggaacgcaatatgaatctggtgctgcaagccttggagattacaggccgcgctgtcgtttgcgtcaatttaatggatgaagcgcgccgcaagcgaatccatatcgattttaagttgttggaaaagcggctgggcgtaccggttgttccggtgagcgcgcgcgcaggggaagggttggatacacttttagaggcagccggccgtgccgctgatcttgagaatgcgtccgcacgccggattcgttacccacaggcggttgaacaggcattggaacagataacaccgctgcttgataaccacaacggcttgcccgcccgctggattgccctgcggttgttatgcgatgatacgccattgatcagcgcgttgcgtcaaagcggtgccgatccacttgcggatgaatcggtttcagccgtgctgtgtcaggcgcgcgaggggctggaagccgccggcgtgactgcggaaaagcttggcgatatgatcgtgtcctccattgtattacatgcggaggaagtttgttccgatgcgattcgcttcgaccgggtcgattataacagctttgaccgccgtcttgaccgacttttgacaagccgggccacaggcattccagcgatgctgttgctgcttgcggttgttttctggctgacgattgtaggcgcaaatcaaccgtcgcggttgttgtcacaggcgctgtttggcttgcagccgcacctgactgctttttttgagatgtggaattcccctgtatggttaacgggagcgctggtagatggcgtttaccgtgtgctggcctgggttgtcagtgtgatgctgccgccgatggcgatttttttcccattgttcacattgctggaggattctggatatttgccgcgtgttgcttttaacctcgaccggggatttcaaaagtgcagcgcctgcggcaaacaagcgttgaccatgtgcatgggatttggctgcaatgcagcaggcgtcactggctgccggatcatcgattcgccgcgcgaacgcctgattgcgatcataacaaacaattttgtcccctgcaacgggcgattcccaacactgattgcaattatcacgatgttctttattggaggagcagccggtatatttgcatcgctggcatccacactgtttttgaccggtgtgatcatattgggtgtcctgatgacgttttttgtatcggcgcttctttctaaaacggtcctcaagggaatcccatcttcgtttacgcttgaattgccgccctaccggcgtccgcagattggacgggtgattatacggtctatttttgacaggactctgtttgtacttgggcgggcggtggcggttgcagcgccggccggactgattatctggctgctggcgaaccttcagatgggtggcgttagcctgttggcgcactgcgcggcgtttctcgatccgtttgcacaattgcttgggcttgacggcgttatcttgatggcgtttattcttggattccctgcgaatgaaatcgtcgtacccatcatgattatgacgtatctttccactggcagcatccaggaatttgataatctgacgcagcttaaaacactgttggttgacaatggctggacctggctgaccgctgtctgtacgatgctgttttccctgatgcattggccctgttcgacaacctgtctgactatccgcaaggagacgcagagttggaaatggactgtggtatcgatcctaatcccgactataatcggtatgactgtctgttttctcgtggcaagtgcggcgcgccttacggggcttgtttgattaaaagagcgggccgctcccaagcggcccgctcttttaacggagtgatgctgtcagttgatcgagcagcgcctcacaaccctcgtacacatcggcataggtagcttcaaaatctccggtgtaccatggatcggagatatcacgcggcgctgatgaaaaatcgagcaggcggtggattttaccatcaggatcgccgccaaagatacggcgcatattggacaggttaaagctgtccatcccgattaaataatcatattggccataatccgaatggataacttggatggcatgatgctcatacatagggattttgtacctgcgcaggacggattgtgttccatggtgaggcggattgccgatctcctcgcggctggtcgctgcagaagctgcgtatatccggtcggagagtccacgccgtgcagccatatcctgaaatacaaattcagccattgggctgcggcaaatattgccgtggcaaatgaatagtactttaatcatatttattacctccacatggtgtacctttactgaatttacatgggcttccttttttgctttgccctttttctttaaatcctccggtttcagatcgaccgcattctcaatgcctgcttgcaggaattcttcattgtcgctgcggttgagggggacgtcgtctttaacataaatgcgataaccagcgcaatcctcagctggacggacaatctccaaccgcacctagcgggccgcttgctttccctgttacagcgcctggcggcctggaggatagaatccagctcggccgtctcgcgatagacagatgggaaatccacatcgaccacggcctcgatgagcgatgtggatacaacacgacagggcagatccgcggccagccgccggcgaatttcttgcaactgaatacaccggtggtggggtacatgagcgtggagagatgaaaccgacattcgctgtccagttattagaaaacttcctgggcgctttttcgcgtattgaccacacaaagcgtctgcgtttatccgttgagctgctttgccagctctgtgtaggtaagccgttatgcctgccaaaagggcactcggcgaaaaacctcccattggcagatgtccggcggacacaattcaattgccggtttttcgggcaggaacatacggaaaataggctccaaagcgggctgcgtagcggtacataggacagcgcagacgccaaagtacttgaccaattggggagttgtatggatgcagggccgcagataagcaattggcatcatctgcacttcatcgaagatcataacgctgtcagcgatgttgtgaagctttcagctctgggcaggccggctggcataaagggattcgcggcaaaaccggcggacagctcagcggtcccacttaaatgctccagaatggtctgcacctgacctgtggcgaagatgtgtgcaagataaggggacggttttatcgaaaaattctcctgccgcggcgttggttgatggtttgacaatgtggggagtatgccttaacaggcatactccccacgcttatcagaatgcttccatttacgctggccgtaatccttacaaataaaatctattcttcgagcattttcttgcaggacagttcgttcagccactgttcaagattgcagagcagctcctggaacagcgcctggtcggataggtcgtcgatatcctccagctttaaaaatgcggcgttatttgaatggcggccgtcaatttcattgaggcatgacaaaatgccgtattccgagccgccgatcccaataaactgccagaaaatcgggaaacgggacgttttgattaaaatttcctcaatcgcccaatccgccgacagatgaccgtccgttacaaacaacaccataaccggcgcacgcaggccgccatagatcatcatgatgtcgcgcatggcttcgggttcgttgttgaattgatagttgagcatactcatccatcgctcaaaaccgcccatctccgcaaaggtataatcgcgcacattgtccattgtgaccgcgccgaattggcggctcttggctgcaaacgcccaaaaatccatcgttgcggcgtcagaaagtgtggatgcgtatgtaaagaatttgtccacaacgcgctgcatacgcccattgcggtactgatcgaacatggagccggagatgtcggagcacatgacaacctgtacagaccgttcagcggcaccgggatagcgcgccagcatgaggaacatgttcttataaagctcagacaggtaagctgtgtcgccgcagcattgacgtgcaagattatccatacgtgtgcagacttcagcgggcagagagcgcaccacattttgaaaggcagcgtttgcgggccggcgcggcgcgcccgcccggataccgcccgccggacaggcgggcggcacgggcgcatcagccgtgccggcaggaaccggcgcagccggcggctgcgccggtgtgggcgaagctacggacccgccgtagctttcaatcaacgctttcaggccaccgttaaagccgcgtccgaccgcacagaagcgccagtcgtcccctttgcggtaaatctcgcagataacgatggcgcgttcaccggaaaattcagcgccggaataagaaaaacgcagcatttctgtctgtcctgaaagcagacggacatatcctttttccagctcgcgcatcgtgtgtgtgccatcgatggagacggcaaaggacaacttggaaatctttgacggcagtttgccgagagaaagggtaaagcgttcagaaccggtagcaacgcctgcgctcaggcaaacggcctgttcaggcgactgcttttgattgtagaaaacaaaatactgttcatctgacagacgtccggcgctgtcaagcccaaaacaggcgacgtcaagctccattggcgctttgtgataaagctccagcacacagtcggctccgccgcaaagcccgctgatggattcacgctgtcccctcaacgcttcgatcattgtttttacgcctcctcagattgaggccgtgtgaaaaaccggattgaactccggcttttcacacaatgcctgaaatcggttatggcaaagcgttattccgcctttgccggaaagatcagcttgcggatggtgccgaccggcagaacgatcagtgagagcaggatcacaacgctccattccttcagcgtgagcggcgcggttcgcagaatcgaaccaccgataaaggtcataaggacttggattgcaacgatcagccccatgatatacaaaaacattttattgccggagatattgtcgaatacattcagcttatccgtgcgtgcgttaaatccgttgagcatggcgctgaatacatagaaacagaagaaaccggtcatgaaatagatatcgctgccgttatagaccatcgggccgtcctcacggaacagcgtcttgaagaatggaacctgcaaaaagatcaggcttgccgccgtgagataaattccaacaacgatcagcgcagaccacatgtttttactgatgatcgattcgtcgcggcgcttgggtttttcattcatataacgcgccagaggcggctctccgccgagcgcgagcgcggcaagcgtatccatcacaatattgacccaaagcatctgcgtaacggaaagcggcgtgcccattccaatgaacggaccgatcagcgcaatcaaaacggcgctgatgttgatcgtaagctggaacactataaatttacggatattgttataaatggtgcggccatagagcaccgttttgacaagagaattaaaattgtcgtccagaatcgtgatttccgcggcctccttggaaacctcggtgccggaacccatcgcaaagccgacgtccgcttttttcagggcgggcgcgtcgttgacgccgtcgccggtcatgccgaccaccagattcttttcctgggaaatacgcacaaggcggcttttatctgtcggaagggcgcgcgccaccacacgcaggcggggcaatacatttttcagctcgtcatcggaaagctttgccatatcgtcacttgtcatcgctacgtcgtctggcgaatcgatcagacccgcgtcacgcgcaattgcggcggcggtttcttttttatcgcctgtaaccataaccacctgaataccggcttttttagcggtatgaatcgcttcgaccgcttcaggacgcagctcgtcacggataccgacaaggccgacaaacgtcatatcctgtaaaagcgaatcgccgatgccgttttcagaggtggcgaaagcaagcacgcgcatggctttttccgacaacgcggacatacgcgcttcaaggcgggcgcggatttcatccgtcatcggatgcggctttaaatcctcgccgtaataggcggtgcagaagccgagcagcttttccggggcacccttgataatagcgcggttaagcttgccgcgcagtacgcttgcggaatatttgttggagctgttgaacatcagtgagtcgctgcactccagcttgtaggtttcataggtgagtgttccgtctacgcccacaaattcatgcagcgcgcgctcggtggcgttaccaccggtcacctggagatgtccgttttgaaccaaggcgattgcgttcgtattgccgcagatgttgatgagcagcatttcacggagctgttccggtatagattcgaacgactggtaatcgtttccttcgggagaggtaaagctgactacctgcaaggcgcccttggtgatggtgccggtcttatccgaaaacaggatattgagactgccagccgtctctgcgccgtcgattttccggatcaggatgttgtccttgaggagctttttcatgttaagtcccgatacaagcgcgatcatcattggcaggccctccggaacggccacgacgatgatgacgacggcaagcgttacagacgaaacaagatcgcgcagaatctgcattacattggcggcggaaaaatacgccgtcgcgcccggcagcagcgtcggattaaagaagatacagttgatcataaaggcgattgcgatgagcgtaccgccgatatatccgaatttggagattgtatcggctaccttgcccagtttgaccttcagcggcgattcgcgctcctcgtcctccttgagctcctgcgcgaggcggccaaactgcgatttgtctccgacgcatttgacctgcatgatggcctcgccgtttgtcacaacagagccgcgatagaccttgtgcttgtccagaaaatcgatctgttcggcgtcataggtgtaatcggcttcggcggccgtcttgctcgcttcctcactttcgccgtttaagctcgcctggttgaccttgatgtcgccgtcgactaggacaccgtcggcgcagaccttgtcgccggcctgcaaaaggacaaagtcgccggttacgatgtcgtcgatttgcagatcacagacctgtaccaaaccgtcgcggcggcggaacgctttgcagaggatttttgaatattcgtcctgcagcttttggaaaagctggttgttggaatattcgctgtacgtggaaaccgttgtggccaacacgacggcgattgcgataccgaccgcttcaagccagtccccgacgccaaagatggcgaaaaggatcgtgatgacgagcgcgacggttaaaatccgcacaagcgcgtcgccgcgaaacgtgtcccatagttcgcgccagaaggatgtctgctccggaggcgtcagggcgttgctgccgaactgttttcggctctgttccgcctgctcatccgtgagagcattgatttcatgtcgattcagcatacgtgatactccaatcatttatttgtcgccccgataggggatcatacaagttataagaatccgttcgaggatttcctcagaaccagcctgagcgggccgttcagaaaagaaaatcgggaaggcgcatggcagggaagcgagggcgctttctccaggcgcgaaggcgtaacggcataccttaagcatcggcaggtcgaaccaggaatcgccgaagccgattgcctcctgcccatcttcaagcgtccgcacacgctcaaggacggcacctttgtcgattgcaagcggtgaaaggtacagctttttccgttcccggaacagctcccatccgcttttggcaagcgcctgcgccagttggccgcacgcggtgtcgtcaaagcgcccctcgtcgacgaaaaagacggcaaggtattcgtaccgctttgataggcactcgattcccgcaagcccgtccaggacctgtcccaccgctccgtcgagatcgatcggcagcgcccgtacggtccgcgcgacgtgcgaagcccaatccatgtccaacgccccatcccggtagaggtacagcccattttgcagcgccagataccggcagctcgcgtcgcggacaaatgagacgcgcatggcctgttcatacccgcgcaacgtattgacgaggcagaccgcgtttttctgtatccgccgcagcaacgccagagcccccggcgtcatataggaaaacggctctccgagccgctgctccacagcggtgacaggcgcgctgccccgcagatggcgctctgtaaaaatcagcgtatggtcgagatcagtggagaagatcatacggctccctcccgccggtccgcgatcagcccgcagcacaggtaaggcatatcgggataaacgcagatggggacgcccttttcctgcgccaacagccggatatgctcggtgtcgggatgcgcaggctcgcgcagcagaatacgatccggcacacggcgcagcagcacacgcgtcgtttcgccaatgctcggcttgatgcggttgatgtccgcaatgccgaaggccgcgccgatttgccggacagcctgcatcccacgccagtcgggcggcggctgcggcgcgtccagggcgcgggcggccgctgaaatttcattgtcgagacgggaaaaccacgacgacactgtatcaagataacaggccgtctgatcgatcgcggcaaattcatggtaaacgcgcgcgccgtgaaagtcctccggcccgatgatcgagcggttgtggacggaacggctgatcaggccgcagattgtgctgttgaggcagcaggacgggttgatgaagtcctcccgggtggcgtacagagagcagcagtgcgctgggtcggccagaacagccagcgtcggacgcagcgccgtgccgtttcgctcgttgaaagcgcggcaggactcctcaagctgcgtggtgatcatgccctttccggtccaaccgtccacaaacacgatttcctgcccgggatgccgcctcagaatcagatggatggcgttttcatcaaaacccttgccgcggatgatgctgacgccataatgcaaaaagtcgcgccccagcatacgtgcggcatagcgccgcatcagtacgccgcacgggacaccggcccgcaccaaggaaacgagcacggggcgtttaaagcgcgcggcaatcagccgcgtcacaatccctgtgtacagcgcggtctgccgtgcttttgtttccaccaaatggttgaaaacacgcatgtaagcctcgctcggcgcctgttcgacaggcagatcctcggaatagtggcggcctgcctggatttctcgctcgcgcagcgccgtgtcgcgttcctcaacaagcccagtgacgtcctttaaaagtagaatcacatcgtcctgtgaaaagctgccgagcggcgcgggcagctccctgttcatagcatcaccaccgaaaccgatttgataccgcgcatagacagatattgtgtcaattgccgcgcgccgcgctcgataaacgcgccgcgttcagcgaacagatatgcgcgttcatacacgccgtccggtacattgtaaagatagccggcggtactgtagcaatcggccgggtcgaatcgcacgccggagacgatggccgatcccggcaacggaaataccggactttgcgtggtagagtggaatgctcccccgccgcagaagcctgcaatcaacgcgggtgcatagatcagctcgccggagccgagatacagcgtgcgcggcgcgtccggcgcgccgattttgtccgcggctgtcctgcaggcccgccgcagtgcggcaaggcgctcctgcgtcatcagccgccgtccggttccaggcaggaaaatgcccggatccagcagcgtgggcgcgctgcctgcagcgccagtcagatcggcgagagcgggagccggcggcgcgccgttttcgagtgaaacaatgcggcttttgagcagggaaatcatctcaatttcaacgccgagccgcttttcgacagcccttcgctgttcgcccgagctgttgtcgagcagcgccagcagcacaaagcgccggatgccgtaagcggcgtgcagccgttcaacgaggcgaaaagctgtgtttccggtcgtgaattcgtcgtcgatcagcacggcccgccggcagccgcgcagaaaggcgtcgtttgggtcgaggtaaagcagatgcgttctggcatgggaatgcgcctcgtcgaaggtgagcggcgtgccgcccgtctgttcaaagcgcgtcgtgctgatataggcagactctcccgaaaagcaatcggccaccgcctgcccaaggccggtcgccgtctcggcaaaaccgatgaacagcgtgcgttcctgtgcgggcagaggggtccgggacgcttcaagatgtgcccaaagctctgcaaacgcagggccggccgcgccgtttatgatggaggcccagtattcaccgtcggtctttcctgcaagcgccagcgcgagcagcttcccggcggccaaaagcgcgccgggacggatcggcagatgcttgccaagcaccttgctgacaaaaaggaacgcccgctgcgggttctgccgcgcagccagcccaaacagcgcatcgggggaaaggccaaagcgcggcgtatccaattccagcgtgagctggaggttattttcaagtgtaaaagatgtaatcatgctttaaattctccgccatataccgcgcgcaggaagccggcagcattggtgttctcctgataaaccccatagacatgcgcgcgctgcagcagcttgcgcgcccagagtgtatggggtttgagttcattcatcttattctgccggacgcttgccaacacgccgacagtgccctgatcgccgctaagaatgcccaaggcgtcctgatattgctcatagggcacagtataacttgcctgcacaagcggaagctgcgttggatggacgcacgttttaccgaggataccgttttgcaggtcgagccgtacctcgcgcagaaggctgtcgatctcatcgctgcggcgcagggcgcaggcgcgcgcaaaggtgctgaaatattcccagactggcccgctgacggtataccggtcgtcaatagcgaaaatgcgcacgatatccgcgatgataccggccgccacagcgatgctgtaaatgggggtgtctacgctgcggcgaatgccgtaaagcccgcagagatctgtcgcgccaacacggatattgaggatctgatcgctttcatccgcgatttcgcgaagctcgcgcagaaatatggtacggtcgtcgcgttccatcaactctcgcgactccagaatcggcatgacataaaagggttcgcatgcgcgccgcccgatgtccgcagccaacaccaacgcgcggcccaaagcatctggcactgctttgggcaggataacgcctgtgataacacggctgtaagaaataaagaactcagccaaatcctcaagcatggcgcaatcctttacgcggacaaacaacaatgggagcctgttttcaggcaggctcccattgtcgagcgcggcggccaactgctcaaactgcctctgcgtattttccacacatctgatgcggtcgtcatccccgacggaatcctccaggcaaaccgccattgaggtaagctccgggattttcccattgatgatggaacgggcgatctggcggttgaaggcgggggtatataaaagcccgccaaccgccaaccgcagcgtttcacgttctgtagttttgaaaaacgcttccggcggtttgaaaaacagactgcttaaatcacagtcggacagatagtcgaaatactgcataaatttgtatcagcctttttgtataatttgtcggctacccgggtgttgaatcatcagacattcaagccgtactgcctgcaaagcgcctcgagtccgccgttgaagccggaaccgactgcggagaacttccattcgccgttgtgacgatagatttccgcaaatacgatcgccgtttcggtcgaataatcctcgcccagatcgaagcggagcagctcggaaccggtctgcttgtccaccagacggacgaacgcgttctgcacctggccgaagttttgtccgcgcgcagacgcatcgtagattgtgaccgtgacggcgattttctggatgtaatcggggaccttttcgaattcaatcgtaacggcctcgtcgtcgccatccccttcgccggtgcggttgtcgccggaatgcgtcaccccattggacgacaggttgttgtagaaaataaaatcggattcatgcgcgcatttgccgtttgcattgagcaggaagatggaagcgtccagatcataatccgcgccgctgtcatactgcttgatatcccatccaagccccaccagcgcgaccttcaggttgggcgcttccttgctcagactgattttttgtcctttggaaagattgattgccatgtaaaaactcctcccatatccgtttatctgtatttcgcgacgatttcactcaggcccggatcatagccgggctggccgacggcattgaatttccatgctccgtccttgtggtaaatttcgcccacgatcatcgaagtttttccggagtaatcctcggtcagattatagctggcgattgtctcctgagaaccctggtcgacgatacggatatacgcattttcgaccatgccgaagtgctgcttgcgtttgacgcagtcgtagatgttgacaacaaaaacaatccgttcgatgccctgcggtaccttggtcagatcgacctggatctgttcggaatcatccatgccgcccattttgccgccgacaaggttatcgccgcagtggtggatgcagccggttgcatgatccttgtggttaaagaaaatgacttcctcggggcttggaattttgccgcccgcatcgagcatcaggacggacgcgtcgatatcaacatcgaccttctgcttaaacatgccaaacaagccgctgctcgcctgaacttccttccagccaagaccaataaggatattggtaagctgcgagccgtccgctttgctcaggttgattttttgaccttttgtcagtgatatcgccatattgatggcctcgctttccattataaattgcgcggctgtgcggccgcggcggttgggatcagacgctcaggccaaagttgcggcaaagagcctcaagcccgccctggaaaccggaaccgatggccgcaaatttccattcgccgccatgacgatacagctcggctacgacaatggccgtctcgatcgaatagtcttcgccgaggtcgtagcggagaagctcctcatttttagccgtatcgacgatgcggatatatgcgtttgacacctgcccgaagttctgtccgcgcgcctgtgcttcatggatcgtgacggtgaaggaaatcttagcgacatcggccggaaccttgctgagcgtgatattgaccgtctcatcatcgccctcgccttcgccggtccggttgtcgccggaatagacgacgctgcctgcggcgtccttgggattgttatagaatacaaagttggtgtcggtatccacctttccctgctcgtttgtcataaaaatggaaacgtcaagatcaaaatcatgaccgccatcgtaacggttggtatcccacccaagaccggcgaggatgctgtcaagaccgggattccctttggtcaggtctactttttgtcctttggaaagattgatcggcattcaaatacactcctttattataatggacatttggatctgttgacaaagctgccgcacccaaaactgcagcgcttaatttcggcatctttcaaaaatactcgttaagtcacaaaggctctcctacggttttttgttttatcttccgaaaaaattgctcttgttttgacactgcttggtttgtcaacagctctattttgccacagggttcaatcactggtgcagacgattctgaaagtcctgcttgagggcttccaacttgactgcatcctcgcggcgcttggcgctggcttcatcctgaatgcggcgcgtttgctcaattccctcgacaatcgtgtgccaggtctgttcaagagtttccaccttgatggagcttgacgaagcgagctgtgcggtcagcttggcctgttcagccgtgttgcgtgcatttttgagaagcatctcatttgtgcgctcgtcgagcgcctgcattgcttccgcctgaatcttctgccgcttgagaaggaccgcctgcgtcaacgcctgcttaaagaccggcagcgtgatgataaacgccgagttgattttgcggatcaggttaagattgctgaactgcatcgactgaatcatcgggatcgactgcatcgctacattttctgcgatgcgcaggtcctggatacgctgctcaaggatggtgcgtgcctgctgcatggcgctcaaatcgagctggagcatatggtcatccgggcgcgcggcgatatccgcctgcatctgcgacaggtactggtccatttccgcaagaccctgctcgccggcgaggatgtatttcaccaggtcctggtaaaaacccacgttggctgtaaagatggcctgaagcttttgattcgattcaccgatttccgcctcgtactttttcagctcaatatagatcttgtcgacttcctcgcccatggtgtgatacttggccaaaatctggtcgagctgtttttgcatccctccgaaaagctttgcgagcacgccttttttttcgtcggaggcaatctcctcaatatcgaatttatccatgattttgccaagcgtcgtgagcagcgttcctgattcgttgatctggttcatattgatgctgtttaagattgtgtcggagcattttgcgatttccgccgcgacctcgccgccaaaggtgacgattgtttgcgggtcatgcacggcgatctgactgacaagccggtcgatctcctgcgaacccttgagcgtgagggccagctcctctcgctttgcggcggcgtcatagacctgcggggcgccgctgtcctgcggggcgccctgctggggggtaaactgtagggccattggatactcctcctttttggatgcggtgcgaaccgccgtttttatgatgatctgcccgggccgaacaaacggcccagaatcgagtcggatctttgcagccttggaaccgtgaggttaaattcatactcgccggcaatcagcgtatcaaaacaatccgcgcgaatatgctgttcgatatttttgtagccggttggggtgaagatcgcgatatcgaagccgacaaggtttaaaaacgctaaaacgatgcagttgttcaatgaaaacattttttcgtcgacatcaaccgagacgacctttgggatctcgcgtgtgaaatcaaaattctggatcagccgcaccagctccacatcgatcccggaaagaacagatacgatgacggccggcaaatcggccgattcatcacaaagcatattgtagtcgatcaggtcctggatcttttccaggatataatcctgtaaatcgtccggcagatggctgtatgcataggccggttcctttttgacagcgaccggatcgagcttatccccgtgcaggcatctcttttgaacattgtctgccggtatcccggatgatttgtcggcggcgatatccgtcagcaggtaggtgtcctcgccaaccaggctgcggatctgcttccaataggcgttgacatcgcccttttccacaccgcagatctttacaaataggtttggaacgtttacaacgccgtcctttgcctcgaaagacgggcgaaactgtgcgttttcatgccagagctgccacacttcatcgtaggtggtgcgcagcgtaacggcgcgcgagcgggtaaactgccggtcgcggaacatgccggtgtcgttgtaaagaagctgatccagctcacgggaggcgttatatgccgctgttgaggcgcgcacacgttcctcacgcgttggaaacggctcaaccggcaggctgctttttagcagcgtctccgtccagatgatgggcaaaaacgcgccggtaaatacatcccgggcggacggatcagggaagaagcagagcacatcgattccagcctgcgccaacacccataaaaggggaagctccgtttccgtgatgttgccataacagacgacaacgggcgtctcatccggggctttgccggcaaagagcttgtccaaacagcgtgtgatccagcaggccagccgcacgccgtaattaaaaaggcgaacacggtcctggatgggaacgcactccaacgcctgcgcaaaagcgcgctgcacagacaaccgccttacctgcccgcaggagggcgcgagccgttcagccagcctgcggatcaaatcgctgcgcgcaccgcgcttatcgacgccgcgaaagggcgccgtttcctcgacagacggcgcggacaaattttgatcaagcagcagccattgcttgacggagccttcaagcgcggttttcagatgaaacaaccggttgcggtattcggcgcgctcatcagcgccaaaccagactgcaaacaggctgtgcagcacgccgccgcgctgcgcagcgggacacataacagcttgtatcgggggcgtaccgccagcccatgaattgatacacggctgatcggacatgctctcccatgggcacggtccgctttcaggcggcttcggcccttgctgcgcggcaggctcaggctggccggcgccggctgtaaagtgaagcgggggcatggataaaagcgcgccgcgcaccagctctgaatatgcgccggcggggtcggccttttgatacgacgcgtctgaacaaaaatcgacataaacaacatcgcagccggcaagatacagcgcgtacagcagcagcgcctcatatttggagatgtcgccctcaaacagaattttaggcggggaggacttgccaatcccgatgagcacgggaccaaagcgggatcgcagccagcacatgaacttgatgtaggcgtttctgacaatgttgtcattgctgccctgttttttgagcagggccagcgcctcggccagcgcctctgccagaaggtcgcgctgcgcggggcggacctgaccaagccacatggtaatatggcgtgaaataaattccctggtgaatgcaaaccgctctccaacggtgctgtaaaagcgggtgatctcgctttcaacgggattgtcgatcccgtcgggtatataaagcccttcgctgcgggtcagttgataaaaggcatgcagatccgcgagcacggcacccccagcgtcgcgcccgatcacgcgatagaaacgggccgactgagggacgcgctgctcaacgggcaataaacactggcccaaagggtggctgctgctcataaattacgtactcccattcaccgtctttttctgcaaacagcggcgaatgctgtgtcaaaaagcctcggaatcaaaaaggattcctgagcttttgcgttgccttctcctgctgcttgcgaaaattctggtaattcttctattttcaaacaagctccagcgaatcattgggcggcttgttatttgcgtccggcgacccatcggaatccgaagcggtagaagtcgtccacttccttgtgtccctggaaaaagcgttcctcgcgttttacctccagctctccactttttcccgacaggcttgcaaaaacacagaaacgatttcggctgtccgggctgtcgatctggatttcaatatcgggcgcgccggactgcttgatcgtaacagacgcgtttgtgccgcgccaattgggcgtaccctcataaataaacgcaaacacaacggcaaaatcgatcagctccggccgtttgaaatacatattttccccgttggcgcttgtcccggagcgatcgtcctgatcaagcaggatataggggagctgcgcggcgctgccaaacgaattgccaagcgcctggatcacgccttgttcgcctgatttcagacggaacatgcaggcaaggtcgaggtcgaccgcaccgccgcctccaaacagttttttacgtcccgtgttccagttcagattgacatgaagctcgccgctgtttttggacagattgatcctgtggctgtcgccgctttttttcaggctgatcttgctcaggttcactttgggagcgggggcaggcgcgggggagggagccggcgcgggagctggggacggcgcggcctgttgctgcggattggctacctgcccgccgaaatgtgtcaaaagcgcatccaggccgccgttgaagccgctggaaacaacagtatagcgccaaataccgtccttgcggtacagctcgcagaggatcaaagcgcgctcctggctgaagttctgcccggaaaagcgataatcagccgagctgccgccgctgcgcagcgaaataagcccctcggaaacgtcacggatcaggccgccgtcggtcgaaacggcgatgaccagcttttgaatctgctccggcaggcgatccgtttgcacagtaaaggcggtctgcgcgccggatgtcatgacaatggcgttgtctggagagcagttttgattatagaagatgaagtatcggtcgtctgaaattttgccagcggcattcacaccaaagcaggtgaaatccgcctcgcccgcaccggtttgcgcggacacaacgatttcgatctgtgtggaggatgtaaaatcggacagctttagcttttgtcccttttgcagttccatacgttccttttctcctttcggggcgtcgatcaaaccatctgcgttttgcctgcaatattcatttgcagagaggccctcttttaccctaaaagcccgtttgcaaccatccgtaaaggcattttttcgaatagatctatgctcctgtgatgatcaacaatttctaagataaccatcatacttatcaactataatacatccatatttcgacaaatgcaatgcaaatttgtgaacaattggtgtaaaattgcgatcattttatgaaaataaaacaaagcgataaaaacccgacggtagttcccgccgggtttctaaaaaggatgcttatccgatctggaaaatagccatcgacgcattgcacgcctgcagcggagatgcaggaagaaggaccgtttccggcgaatatacgcccaaaaaaatttgctctccttctgtaaaaggatatagaaagctcccgctcacacaggcataattaatcagcatcggctttacagagcctgtgatggccgaaggcacagcgccgttttgaaggagaacgccaacgccggcgttggtattggctccattgattggcgtgatggaatagataactgcataaaatcccgtccgcagaagtgtgaccgtatgtccgtcgctttccaatctcatataatagggggcatccgcctgaagctgtatcgggacaaaatatccggcgggttccaagctttgggccatgtaggaataaaaattgccggatgcggggaaaggaagcgtcccgcaggcgccggtgggacctgtagcaccggttgggccagtggcgccggtcggaccagtggcgccgggaattcctgttgggccggtcgcgcctgcctggccgatcggtccctgaggtccctgcggcccaaccaccccttgcggtccagccggaccggttgcgccggtcgcgcctgcggcgcccgccgggccttgaataccagcctgccccatggggcctgtcggtcccgccggccccgctggtccttggattccggcaggaccagttggtcccgccggtcccggaatcgggacgacgcagcagcagcccggcggacagcagggcggcctgggcacaaagcgttggtcgttcatggatataacctcccgtttcaagagaatgtgaaccgaaaacgtgcgctttcggctttggtgaatttcgctttgaccggcggccgatttggctgtgggataggcggcggccgggaagatgcggttccctatcaatcattttatggctgaatgtgaaaatgcgttcttttttgcggtgaagcattacaattttccacatgaaacggggccaataaacagtatgcgcgccggaagcttccggcgcgcatcttgggactgtttcaacatcttgtcggaaagagatcgtacatccaagcttttaacagagcgatttttacaaatccttgacatagctgcggatcacatcggtggaagcgtggaattttgcctgttcctgctctgtcaaagggacttggacaatctccttgacgccgctgcgtccgatgatggccggcacgccgcaaaaaacgccgtgttctccgtattcgccctcgagcagcgtggaaacgggaatgatgcggttttcatcgtgcaggatgcatttgatgatgccggtggcggtcgtggcgatgccatagtaggtggtgcccttacgccgcaggatctcccagccggccttgaccgtgtcgtgcacgagcttgtcaaggtctaccccctcaaagcggccgggattatcgcgcagaacttccgcgaaggttttgccgcccacggtgacgcgcgaccaggggacggtctggctgtcgccgtgctcgccaagcgcataggcgtggacgctgcgcgggtcaatgccgaccagctcgccgatcagcgccttgagacgggcggaatcgagcgccgtgccggtcccaaggacctgattttttggcaggccggacagcttccaaacatattgcgcgatgatgtcgaccgggttggagatgatcaggaataccccggaaaaaccggcgtccatgatcgggccaacgagcgaatcaatgatttttttggagagatcgagcgaatcgaggcgcgtctgcccctccttcggtggcggtccggcggtgatcacaacaatatcggcgtcgccgcagtccttgtaatcgccgacggaaacctttacgttgcgtcccagatagtcgataccatcacgcaggtccatcatctcgccgtgtgcgcgctcctgattgatgtcgaccagcagaatttcgtcgcagacgccctgtgtcagcaggctgaacgcggtggacgatccgactaatccagccccaatgacagagaccttgcttgcattcattctcatataaggctgcctcccttagctgttgtatacaggcttgccgtctgggagcctgtccggctttttcctcaaattaagccttagtagtatttccgcaccgtaccatcgaaatccgggcggcacggattttttacaaaaaggcgggcggcaaacctgccgcccgcctttgggtatgtttgaattatagcaattttgcacgaagattgcaagtgatttttagataaaattttaattatcttccgccatcaggttacatacggaattcgaaaaggcaaccggatcgtcaattgacattccttcgatcagaagcgcctgagaatataaaagcgatgcgtattccttcaggcggtcacgcttgttttcatcggcatacagcttttgaattgcggtaaacaccggatgcgacgcgttgatttccagcacgcgctccgccttgaccttgttgtcgttcggcatggcgttgagcacgcgctccatttcgagcgagagcatcccatcgctggccagacagaccggatgtgattttaagcgtccggacaggcgcacctccttgaccttgccgccgagcgattcgcataaaaaggccagcagctccttgttttcttcattttgcttttttgtttcctcctgttcggccgtgtcctccaacccgagatccttgtccgatacggacttgaactgcttttcctggaaactgtaaagcatcttgagcgcaaattcgtccacgtcgtccgtcagatacagaatttcatatccctggtcgcgcagaagctctgtttgcggcagcaggccgatcttgtcgacggtttcgccgcaggcataataaatatatttctgcgattccttcatacggccgacatactcctcgagcgtgaccatcttctgttcgctcgacgaataaaacagcagtaaatcctggagcagatcctttttcgcaccgaaagcgtcgtaaacgccgtatttaagctggaggccaaagtttttaaagaaggcttcgtactgctcgcgcttattgcgcagcatcgaaagcagctccgaatgaatttttttctccagacgtccggcgatcagcttgagctggcggtcgtgctggagcatctcgcgcgagatattgagggagaggtcctgagaatcgaccagcccgcgcacaaagctgaagcagtccggcagaagatcggcgcatttatccatgatgagcacgccgcttgcatagagctgaagtcctttttcatagtcgcggctgtaatagttaaagggcgcgcgcgacgggataaacagcagcgcgttataggtcgcggatccttcggtattgctgtggataacaagcgcggggtcctcgaaatcgccgaatttttccttgtaaaaattgttgtaatcctcatccgtcagctcggaacggtttttgcgccagatcggtaccatgctgttgagcgtttcgttttcagtatagtcctcgtattccggcttgtcctccgggcagccttccttcaggcggcgtttgggcatgtccatgcggatcggatagcggatatagtcggagtagcggcgcacaagcgcggcgatgcggtgcgcgtcaagaaattcgtcgtaattgtcctctccctcgttgtccttaatgcgcaggacaatttttgttccgcgctcggacatgtcgcacggctcgatcgtatagccctcgataccgcggctttcccacttccaggcttcgtcggcgccgtgctgacggctgtaaacggtgacgcaggagctgaccataaacgctgaatagaacccgacgccaaactgcccgataatatcgatgtcatccttatgctcgccggtttcctcctgcttgaaggcgagcgacccgctttttgcaatcgtgccgagattgctttcaagctcgtcgcggctcatgccgattccgttgtcaataactgtaagcgtgcggttttcccgatcgatggatagattgatcgcaaaatcgtcacgcgacaggcccgtgatattttcgttgagagagtgatagtaaagcttatcgatcgcgtcggaagcgtttgagatcaattcgcgcaggaaaatttcccggtgcgtataaatggagtggatcatcatttccagcaggcgcttcgattccgccttgaattgctttgttttcatggcatcagaactccttttatatgaatgttttaaatccagcggaattagcactctttttatatgagtgctaaccatactataatatacctgtcctgaaaaatcaagtataaattgtgaacaatttggagtcagcccgtgcgtaggcgcggttgaatcgctcttatgcatgtggtatactgttattgtgagttatcaaaaatccgagggcttggtgagggacatgcactacaaggttgttttgtgggattttgatgggacgcttgtcgatacgtcggaggggattttccgttcactggaatatgcgttcaggcagcttggaacgccggcgccgggccgtgatgtactgcgcaggttcatcgggcctccgctgctttattcatttcagacctacattggcatgtcctatgaggaagccaagcgcgccgtgcttgtgttccgggacgattacgaggcgggcggcatgtatcgttcgcgcgtctacgacggtctgcccgagttgattgcgcgtctgcgccaaaacggcgttaagacagccgttgcgacgctcaagccggaggcgacggccaaacagcttttgcatcatttcggcatggagggtctctttgacgcctgcaccggaaatacgcctgatgaaaacgatcagacaaccaaggccgacatcatcagaaggacaatgcgccgccttgaatggacagactgttcatcgatggtgctgatcggcgattccgtctatgacgcgcagggcgcgcaggaggtcgggatcgattttatcgcggcggcctatggttttgggatcggcgccagggaacgcaccgcgcttgactgccgttttgtagccgaaatgccgcgcgatttgaacacattttttttgcaggataaatgtggtgtatgaaaaggaggggaatcggttggatcgaaatttgatggcggtggttgaaaagcgcatcgaccgcacgatcgggaacctgaaaaacaacaaaatggatgcctattatgccgaaacatgcgccgatgcggtggcgctggttcgtcagctctgtcctgcgggtcagaccgtctcgtgcggcggttcggtcacgctggaggagtgcggcgtcaagaagttattgcgctccggggaatatacgttccttgaccgcgaggcgaaaggcgccgacccggaggatatataccgccggacgtttggctgcgacacatttttttgcagcagcaacgcgattacggaagcgggggagctttacaacgtggatgggcgcggcaaccgtgtcgcggcgatgatctatgggccgaaaagcgtgattgttgtggctggctacaacaagattgtgcccgacctggaggcggcgcgcgcccgtctgcgcgatacggcggcgcccgcgaacgccatccgcctgagcacgcgcacgccctgcgccgtactcggcgcgtgccgggactgccacagcgacgaccgcatttgctgcaattatgtcgtgatggggcagcagctcattaaagcgcgcgtcaaggtaattattgtgggtgagacgctcggattttaaagatatttaaaaacgttccccggagactgccgtctccggggaacgttttgcaagtgtcagatattgacggagcgcgcgcggtcgaacagctcctgaacctctctggaaggctccttatcagtcagcgaaacgatgacgatcaccgccagagcgatcacaaagccaggagcgagcgaataaaggccagtggccgcgagcgcgggaatattttcccacagcacgacggtcaggccgccgacaaccatgccggcaacgcaccccttcatggtcaggcgcttccagaacagcgagagcaggatgaccggtccgaaggacgagccgaagccggcccaggcataggagacaaggcccatgacgctgctgttcgggtcgagggcaagcagataggcgacgaccgcgataatcataacggctgcgcgcgacacccacatcagctccttattggaggcgttgcggcggaaaagcgccttgtaaaaatcgttggaaacggcggacgcagcgacaagcagctgcgaatctgccgtgctcatggcggccgcgaggatggccgaaagcagcacaccggcgataaagcccgggaacaggcgcgtgacaaggtccatgaaaatgacctctgccgcaccggcatccgtgtaatagccgtgattgccgaggaaagccaacccgatcacgccgacgcagacggcggcgacaagcgtgattacaacccagatcatggcgatgatgcggctctttttaatcatggcgctgtccttgatggccataaagcgcacaagaatatgcggcatgccgaaatatccaagcccccagacaagcccggaaataatggttacaagcgcgacttttccgctggcgtcagcgaacaggttgagaaaattgtcgccgcccaggctcacgatgaaatcagacgaaagaccgggcgtattgaacgcggctgcaatcggcacaatcacaagcgccgcgaacatcagcatgccctggatgaagtcggtccagcatgcggcgaggaagccgccgagaaaggtgtatgcgatgatgacgatcgagccgattgtcagcgccgtgacgtagtcgaagtggaatacatattggaacagcttggcgcccgtgctgaacgcggaagctgtgtagaccaggaagaatacgaaaatgatgacggcgcagacgctgcggatcgcagtcgatttgctcatgaaacggttttgaaggtactgcgggatggtgatcgaatcgtcggcgacatacgtgaatttgcgcagccgcactgcgacaagcttccaattaagatatgtaccgatccccaggccgatagcaatccacgcggcggaaagcccggaccagaacgccgccgcaggcagcccgagcagaagccagccggacatgtcggacgcctgcgcgctgagcgccgtcacccagctgccgagctgccgtccgccgagaaagtagtcggaaatgtttttcgatttcctgtagaagtagatgccgatggcgagcatcgcgccgaaatagaggataaatgcgatcaggatgcttgtgtcaatctgcatgtaaaatccctcctcaaattttgccgcaaccttttacctctttgcttgctttttgtacagatagacattattatacataatgcgggctttctttgcaagtgcggattgccgcgctgcatgtttcaaacgggacgatcatgatgatggaggagatgaatcacgtcatgaagcggatgctggcccagtgcgccggatcgaccggcgcgctgttgatttcatatctgcttagcagatatctgttttttgacctgcacggcatgaaatcgtttccgttttacctgctgtgcgccggcgtcgccgtatcggctgtcgcggcgttttttcacgcgggaatcttgtccgctgcggcggcagtgggatacattgccgggtttttctgcggtatggcgttcggcagcgtgggaaccgatccgggcggcggccgcacctgcagcggatggctgatttggggaggcatttttttcggttgcctgctgatcggggcggttttgcagcttgtgcggcgaggcggccgaaagccggacggttaagctgaacaggtgtatttggagcaaacggagagcggcccggctcaagcgcgaacagccgatgaaaaatatccacagagaacaattattattgacagaaggcttggagctgttataataggaatatattgtcgaagcatggcggagcggtggagaaccgcttgacgctgtgggcattgatataacacaggaggaacttaggtgatgtttggtaaacgcggcaaacatttgatttcagttatgatgacgctgctttgcgcggcttttcttggcatgcctgtatttgccggcattccttccacgggcgatggcagcggtatgcttctgccaattatgggcggattgttggtcgtatccattattctgattgttgtatatgttattctttccaagaagaaaaaacggtagcagtttggggcagctggcctccccggattgcggggaggcgtttttatttattcaccgctttatctgaacaatgtgcgaaagcgcaagaaatcgctggaatcgcgcccattctattgtacgaggccgggcgcggtgatataattatatgtaattgcggccgccacgccgtgcaatatgaaaaaaggcaggggggaatggcttgcttgagcagctaaaccggattgtggttgtaacaggtcattacggcagcggaaaaacgaatctgtcggtgaatctggcgatgagcctgcgcgccgccggcgaggaagtcacgcttgtcgatcttgatattgtaaacccatatttccgcagcgccgacttcgagacgctggcggaggaaaacggcatccgcctgatcgcgcctgtatatgcgcgttccaatcttgatatcccggcgctcgacgggcggctcgacgcggagcttgacggcggccggcgcatcgtgatcgacgtcggcggcgacgacgcgggcgcggccgcgcttggacgctacagcgcgcacatcaaggagagcggcggatgcgatatgctgtatgttgtcaacgcttaccgctatctgacgcgtacaagcggcgaagccgcccagattctcggtgagattgagtgcgcggcgcgtctgacggcgacggccgtcgtcaacaattcaaaccttgcggagatcacaacggcagaggacatctcgcgttcggcggcatatgcccgggaaactgcgctgcaatatcagataccgcttttatttacggcggcgcgcgaggatctggcggacgccgtgcgcgcgtatgcgcccggcctgccggtttatccggtgcggatttatgtcaaaaagccgtgggaggcttaaagccgctcgcgttccataaagcatgttttaatgaaggaggtgttgaggtatggcgaaaatgacggtcaatcgggacacgtgcaagggctgcgggctttgcgtgcaggtctgccctaagaaaattatttctcttgacaaaaaggcgctgaaccagaaggggtatcatcctgcctgcgtcgaggacatgagcaagtgcatcgggtgtgcgatgtgcgctcagatgtgtccggactgcgcgattacggttgagaaatagaacgggcgccgcctggcgcagcgcgccggggcggacagtatgcaaggaaaggcagtgaaaacatggctctgaccgaaaaggttttgatgaagggaaacgaggcgctcgccgaagcggcgatccgggcgggctgccgtcattttttcggatacccgatcacgccgcagacggaagtcgcggcgtatatggccaagcagatgccaaagatcggcggtacatatttgcaggctgaatcagaggtcgcagcgatcaacatggtctatggcgctgcgtcggcgggcgtgcgcgcaatgacctcgtcatcctcgccgggtatttcgctcaaatctgaagggatttcctacatggcgggcgcggacctgccgtgtttgattattaatgtgcagcgcggcagcccggggcttggcggcatccagccgtcccaggccgattactggcaggcgacgcgcgcgcccggtcacggcgatctgcatgtgcttgtgttcgcgccgtcgtccatccaggagatggtcgacatggtatttgacgcgttcgatctggccgattgttaccgtgtgcccgcgatgattctcgcggatggcatgctcggccagatgatggagccggtcgtattcccggagcgcacggtcaagcagtatgacaagggttcctgggcgaccaacggccatcagaatcagcgcgcgcataacattgtcaactccctgtacctccagccggacgagctggagagccgtatccttgagcggtttgaacggtatgagcaaatcaagcagaagcacacgcgcagcgaggaatatctggttgacgacgcggattatatcgtcgtcgcatacggcgcgacctcgcgcatcgtgcgcagcgctgtcaatacggcgcgcgccagggggatcaaggtcggtatgatccgtccgatgacgctttggccgttcccggcggagccgattgcgaaggcggccggacatgcaaaggctttcctcagcgtggagatgagcatgggacagatggttgacgacgtgcgcttggcggtcaacggcaaggcgccggtcggtttcttcggacgcaccggcggtattattccgacgccggcggaggtcctttcggaaattgaaaaaatggcgggaggtgacaagtaatggcagttgtttatcaaagaccgcacgcccttctggacgtgcccacgcattattgccccggctgcacgcacggcgtgatccataagcttgtcgcacaggcgatcgacgagcttggctgcgaggggcgcaccatcggtatcgcgcctgtcggctgttcggttatggcgtacaattattttggctgcgatatgatcgaggctgcgcatgggcgcgcgcctgcgattgcgacaggggtcaagcgctccctgccggacagcgtcgtattcacttaccagggcgacggcgacctggcggccatcggcaccgccgaaacggtccactctgcaacacgcggcgaaaatattacagttatctttgtcaacaacgccatttacggcatgaccggcggccagatggccccgactaccctgccgggccaggtgacgcagacaacgccgaccggacgcgacgtcgcttacgcgggtttcccggtgcgcgtgtgcgagatgctctcgacgctttccggcgttgcgtatgccgagcgcgtggcggtcgacagcgtgccgaatatccgcaaggctgccgccgcaatcaaaaaagcgtttacctgtcagattgaaaaaaagggcttttcaatcgtcgagatcctgtccacctgcccgaccaactggggacttacgcccgttgaggcgctccagtggctgcgcgacaatatgatgccgtattatccgctcggcgtctatgccgacaaaacggaaaagggggtcaggggctgatgctgagtgtgcttttagccggcttcggcggccagggcgtcctgttcgccggaaagatcatggcgtacgccggtttgattgaggaaaaatatgtttcctggctgccttcctacggccccgaaatgcgcggcggtacggccaactgttccgtatgcctgtccgacgagccgatcggctctccgcttgtgctgaatcccgatgtgttgatcgcaatgaacctgccgtcctacgaccggtttatcgatcaggtcgcaccgggcggcatcgcggtcattgacagctcgctgattgcaaaaaggagcgaccggactgatatccgctgcttttatgtcccggcggctgaaaaggcggacacggagggcctttccggcctttcgaacaatattctgctcggaaaggccctccaggaagcgcgctttgcttcccttgaggcggtggagcaggctgtagccaaatgcgtgccgcccaaaaagcagcaccttttggagccaaatatccgcgcgatcaaattgggcatgagcctataatgcggttgcgtaccatgaagcgcggcgcccctgcgtcaaaaacgcagaggggcgccgcgcttgtatattcggcagcgatcggatataatcaaaagcgtacaaccaaactgctcttggaaggaggaagcggcgatgctgcatttgatttttgggacggccggcgccggcaagacgacgctgttgcatgaacgcatcgccgattgcgtgtcgggcggcggcagggcgatcctgctggtgccggagcagtattcgtttgagagcgaaaaggctctttaccggcggttgggcgctcgcggcgctttacaggtggaggtgttaagctttacgcgcctttgcgaccggattttccgggaatacggcgggcttgcgggcgtgcatctggaggaggccgcgaaatatcttttgatgagcgtggcgcttggcgaggtgggcggcgcgctcaagatctatggaaaaaatgccgcaaacgccgcatttgcggcctcaatgtgcgagcagatcagcgaattgaaaacagctggcgcgtctcctgaggctctgcgcggcgcggcgcaggatttgggcggcgcgttcggggacaagctttcagacatcgcgcttatttttgacgcgtatcaggcggtgatcgaacgcggctacagcgatccggacgactgtcttgcgcgcgcctgtaagcgcctggagggacggaatttttttgccggctatgatgtgtttattgacggctttatggcctttatgggcgcggaatggaaacttttgaagtttgtgctgacggacagcccgcatgtctgggccgcgctgacctgtatgggcctttggcagggcgacgggaccggcgcgctcgcgtgcgcggcgcatacggcggcgcgccttgtgcgcgccgcgcgggaggcgggcgcggctgtggccgcgcctgttttgctggaaacgccgcgccgcttcgtacccggcgcgctcgcatggattgcgcaggcgtatccgcaggagacgcctgcgccatacgacggcgcgccggatggtgtacagattgcggcgtgtgaggacgtatacgatgaaatcgaatatattgccggggaaatctgtgcgcttgtccgcgagaagggatatcgctaccgcgacattgcgctgatcggacgcgctttggaaccgtaccttgtcccgctggagacggtatttgcccggtatgatattccatattttgccgaccgccgcgttgatatccaggtccatccgctcgtaaatggaattttctgtgcgcttgacgcggtacgcggtcgttttgacagcgaggcggtgctcgcgcttgcaaagacatgcatttccgggattgacgccgtggaggcagggctgctggaaaattactgctttacctggggcgtatccggcgcggcgtgggccgcgccgtttgtaaatcatcccgacggaatggagggggcgttttccgacgagcagcgcgaacgactttcacggatcaacgccgcgcgcgcggcgttgatcgggccgctggagcggctggcggacggcctgcgcggctgcgacgggcgcggctttgcgcgcgcaatctattcctatttggagcaggttgacgctgcgcgccgtttgcgggactatgccgaagggatggaggagggggatgcgcggcgttttcttgatttaagcgcgcaggtttgggacgcggtgatcggcctgctcgatgtgttcggcggcgcgctcgcaggcgtttctctgccgcctgcccgtctgacagacctgctgcggttgggcgtgtccacggttgatatcggttcgctgccccagacaatcgaccaggtgatcgccggtacggccgaccgtatccgcccgaacgcgccgcgcgcagtctttgttatcgggctgaacgagggcgtgttcccgctgtggagcagtccgtccggcattttttcagccgccgagcgcgagcgcctgcgcacgcagggggttgatctgctgcgcacaccggagcagacggcgctttttgaacggtattatgtttactttgccctgacgcaggcgtccgaggcgctttggctgacctatccgctgcgcgatgcggcgggggccgcgcgcacggcctcgtccgctgtggacgaggtgcgcgcccttgtgggcgcgccggcgcgcggctctgccggcggcgcgctggcgcgcgccgccggagaacgctccgcctttgacgcaatgatgcgccattggcgcgacgatacgccggaaacagcggtgctgcgaagttattttacggagcaggacccggcgcgcatccgcacgctggaggcgctgggcgcgccgcgcgccttcagtctggaaggccgcggcgcggcgcgcgcgctgttcggtacgcgaatgcgcatctcgccgtcgcgtgctgaattgtattatgaatgcccgttttcctatttctgccgggtcggcctgcgtctgcgcccgcgccgccgcgcggaattcaatccaattgaatccggttcgctgattcatctggtgcttgaaaagattgtgaagaaatatggcggccgcggccttgcgcagctcaacggcgagctgctgcgcagtgagatcaccgcgatcatcgacgcggatttaaaggcgcgcatcgccaattacgacgagatgcccgcgcgctttaaatacctgttccgccgcctggtcggcacgcttcagcgtttgatcgagcggctggcgcttgagtttggccaaagcgcgtttgaacctgcggcgtttgagcttcccattggacttgacgcaccggtgcagccgctcgacctgcgcgcgccggatgggacgcgtgtaatcgtcgaagggattgtcgatcgcgtcgacgtgctcgaacaggacgggaaaaaatatgtgcgtgtcgtcgattataaatcgggcgcgaaaacgttcagcctttccgacatctgttatggattgaatatgcagatgctgatctatctcttttccatctgcgaggcggacggcgccgtgccggccggcgtgctctacatgcccgcgcgcgacagcgttatacaggcagaaaggaacgcgtccggcgaggaaattcaggcgcagcggcttaaacggctgcggatgaacggcattctgctggaggaccgctctgtgctctcggccatggagccgaatctcgcgggcgtgtttattccagtcaaaacaaagaaggacggcagctttgacgcacgcagctctctggcgtcgctggaacagatggggctgatccggcgtgaggtggaacgccatttgatcgggatcgcacaggggctggccgacggaaaaatcggcgcggagccggtcgaagggctttccaattacaggccgtgcgactggtgcgactatcacgctgtttgcggtcatgaggacggcgatgcggtgcgccgtctcgcggagcttgaccgcgctgaagcgatgaaacggatggaggaggggatgggcgatggctgaacgacaatggacgccgcagcaggcggatgcaatcgctgcgcgcggcgggaccgtgcttgtgtcggccgcggcgggaagcggcaaaacggctgtgctggtcgaacgcgttgtcggacgtatccttgacgaaaaaaatccggtcgatgcggatcgtctgctaatcgtcacgttttcaaacgcggcggcgcttgagatgaaacagcgtatcatggcacgcatgtccgagctgattgcggcgcatccagaggaccgccgcctgcgcaggcagcagcttctgcttgggcgcgcgcagatcagcacgattcattcgttctgtctggagctgatccgcagcaatttccaggcgctcggcatcgcgtcgaacacgcgcgcagctgacgagcgcgaattggaaatcatgcggcgcgactgcgcgcgcgcgtgcatcgagcaatttctgtccgacgacgcggacggcgggttttcacagcttgtcgagctgttaagcgcgggccgtgacgaccgccgggtgtttgatacgctgttttcgctctatgattttgtacgtgcgcacccattttacaacgattggctggacgataagctcgcctattacggcgaaggcgtgcgcgcggccgattccatctgggggcgctgtatccttgactatgccaaaggcgcgctggggcatgcggcgtccctgctgcgccgcgcgctcgcgctggcagcgcaggacgaggccgtacaggcggcgtatggcgccgcgctttccggcgatctgttgcagcttgaacaaacttttgccgctctcacagcgcgcgactgggaccgcgtgcaggaacggttgcgcctgtttacatttgaaaagctgcgtccgctgcgcggcgacagcccacaaaaaagcgccgtgcaggcgcttcgcaaaagcgcgcgcgccattgtggaggagctgcgcgaccggcagttctgcgcctcgtcggccgagtttttggacgatgtggcgtttttgcggccgatggtatcgctgctgttcgatctgacgcgcgcgtttgaccgcctgtttacggaacaaaagcagcaaaaatacctgatggatttttccgatatggagcagtatacaatttcgctgcttgtaaaaaaagccggtccaggctatgcaaagacagagcttgcacaggaggcgggcgcgctctatgacgaggtgcttatcgacgaatttcaggacacgaacgccgcgcaggagatcattttccgcgccgtatcgcagaatgaaagcaacctgtttatggtcggcgacgtcaagcagagcatctaccggttccggcaggcgatgccggaactgttcatggagaaaaagaaacgatttgcgccatatgatggaaagacgttcccggccaaaatcgtgctggggaaaaattttcgcagcgcgcaggctgtgaccggctgcgtcaattttttcttttcacagctcatgagcggtgaaatcggcgaggtggactataatcaggaggaggcgctttcgccgggcgcgtcctttccggagggaatcgaggcgggctgtacgctgcgcctgatcgatgcgtcgcagtatgccggggagcttgacagcacgcagcttgaggcgcgggacgttgcggaacagattgccgggatgctggagcgcggcgaccttgtcgctgacggcggcgtgacaaggcgcgtgcggccgtcggacatctgcgtgcttctgcgttcgcccgcacagaaggcgcaggcgtatttcgacgcgctcacgcgccgcggcgtgccggtttgggcggagccgaaaagcgggtttctgacatcgcgtgaaatcgcgccggtcgtcgcgctgctgcgcgtgctcggcaacccgacgctcgatatcgattttgcctcggcgctgctgtcgccgctgttcggcctgacagccgacgagctgacacagatccgcctggcggaccggcgcgcgccgctttacatcgcggccgccagggccgccggggcgggcgattcgcgcgcggcgaacgcggtcgatacgatcgcgcgcctgcgccgctttgcggccaacgccacagccgacgctgtaatccgcaaaatttatgaggaatgcgattatatgggcaaggtgcaggcgatgcggatggggcaggcgcggcgtgcgaatttgctgctgctggtacagtatgcgtgcgattatcatgcgggcggctacaaaggattgagcggttttatcggctttgtcgaccgcctgatcgaccgcggcggcgactttgctccggcggcgagcatgtccgagcaggccgatgtggtgcgcgttatgagcatccaccggtcgaaggggctggaatttccggttgtgtttctttgcgatacggccaagcggtttaaccgcgaggatttaaacggcaacaccctgctgcactcggagcttgggtttgcgtgtgtgcggcgcgactttgagctgatgaagcagtatacgaccgtaccgatgcaggcgctgcgactggagcttgagcggtcgatgctgtcggaggagctgcgcgtattgtatgtggcgctcacgcgcgccaagcagcgcatcgtcatcacgggcgtggtgacgaaaccggaggaacggctctgcgcgcttgtgtccgagagtgggacggacgggaagctgccgccgcatcaggtacgcggcgcgaacgcttatctcgactggattttgatggccgcggcgcgccatccagctctggccgaacgcttcggcctggcgggcgcgccgctggacgcttccgaggcgccgctcaccttcgagctgaaggcggcggccgacggcgaaccggacgcggaaaaaaccagtgaaacaacggcggcctcgccggacgaagcggcgctggaggcgctgcggcgccggctggcgtttcgttatccgtttgaagcacagacaaaaattccgacaaagatggctgtttcacagcttgccggcagcgcgtatgccgcgtcctaccggttttcggcgcgcccggcgtttttgcagggcgacgggctgacgggcgcgcagcggggaaacgcgctgcataaatttatgcagttcgccgattatcaagccgccgcgcgtgacgcttcgggcgagatcgcgcgtatggcgcgggagggatttctctcacggcaggaggcggattcgatccgcccggaccgcgtgcgcgcgttcttttcctcgcggctggccgcgcgtattttttcggctaaacaggtctggcgggagctgcgttttctggcggaagccggcgaacgggagcttggcgcgtacagcgcgctgtttacaaacggcggggaaacggcgatccagggcgtcgcggactgcgtgttcctggaggaggacggtgcggtcgtcgtcgattacaagacggaccgcgtcaaaacacccgacgagctgcgcgagcggtaccgcgtacagctcgccctctatcgaaacgcgctgacagaggcgcttggcgtgccggttaaggaatgcgtgctgtattcgttcgcgctgtcctgtgagattgtattgtgaaaggggaatcgccatgttgaatcagcggtccggcgcgcttgggtcggctatgcagcaagccggaaggcaacccttgagccgcgcggacgcggcgatgcttgcggacgggttcccgaaacagctgcgcgcgtccgtctgctgcgtctgtgatcgaatcccgatgcgtacctattccaatgtcggctgggcggcgagtgaggatcagctttcctggctgctgccggacgggcaggcgattgcctttccgttccgcctgtatattcttgacggcgtgccggccggcgttttcacgcctgtgcagcaaacgatttaccactgcctgttttcaagaagctgcgacggctttgtccgggaacgccatattggcgcgcttttggagggggaaccgccgctgtgggccataccctatattttgaaggtatgcgatgagtacgtcgtcgagattttggagctgatctatggccggcttgcccaaagggatacaaaatggtaccggcagttgttcagcttcaacccgcgcgcgctcctgtcaggctacaacaggatgatcagctattggaatgcgtattacaggcaccgttggagcagttaccggcagtatgtgggattccggctttacagggaatgcttcgggtatacagaccgctctggccgtcgggcgcaaaacaggacttgacaggcgggaaccggtgtgataaaatagatcggtaaagaaagtggagcagcaccctgttctcacctcgccgccagcgggcggctggtcaatacagcttgccggcagcggcaaggtatgtttgattgttgagcgtggggaaggtatgccccgcgctcaatttattttgtttgaatcggttttggaggtgtttcgtattagcagcaaggatttgctcatcaacgaggagatcagagacaaggaggtccgcctggtcggtacgcagggcgagcagctcggtatcgtgccgctggcaaccgcgcagaacatggctatcgagaaaaatatggaccttgtgaagattgctcctcaagccacgccgcccgtctgcaagattatggactacggcaagttcaagttcgagcaggcgaagcgcgagaaggaagcccgcaaaaatcagaaggtgatcgagatcaaggagattcgcctctccttaaatatcgatacaaacgattttaacaccaaggtcaaccgtgccatcaagtttttggagggcggcgacaaggtaaaggctgccctgcgcttccgcggacgtgagatggcgcatccggagctgggtacaaacattatgaaacgctttaccgaggctgtggccgaatacggaaatgtggaaaagctgccgaaaatggaaggccgcagcatggtgatgttcatttcgcccaagcccgtaacaaccaccaagggaggaaataaaaatgcctaagctgaaaactcataccggtgcgaaaaaacgcttcaagctgaccaagaacggaaaggtcaagcgcgcccacgcctataagtcccacatcctcaccaagaaggataccaagcgtacacgccgcctgcgccattccacctatgcggacaagacgaatgtggcgacgatcaaactgctcgttccttataaataatcggaagttgacggaggtatacggatatggcacgtgttaagggcgcaatgatgacccgtaaaagaaggaaaaagacgctgaggcttgccaagggctattttggcgccaagagcaagctctttaaaatggcaaaacagcaggttatgaaatccggtaattacgcttttatcggccgcaagcagaaaaagcgcaatttccgcagcctgtggatcaccaggatttcggcggcctgccgcacgaacggcatcaattacagttctttcatgaatggtctgaaaaaagccggcgtggagctgaaccggaagatgctgtccgaaatcgccattcatgacgccgccgcattcacggcgcttgttgaaaaggcaaaggcagccctttaatcttttaacgcccgcggtcaaaacgcgggcgtgtttttatagctttccctccggccgttcaaggccgggggacagtgggattctgcgcgcggtttttgcgtgcaaaaggggggcctgtatgcgcggacagacaattacttcgcgcgaaaatccggcggtaaaacagtatacggcgcttgcgtcctcacgccggcgcaggagagaggatggccgcttcacaactgaaggcgtcaagctgacgcttgaggcgttcacagcgggttatacgcccgaggcgctttttctcacacaggatttgacggacagcgtcaggcggcggctcatgcccgtcgcggctgcgtgccggcgtctctatgagatttcgccgtccgtagcagccaagcttgccggagcggttagcccgcagggcgtttttggcgtgtttatgatgcttgacaacaggacgcaacctgttaaaataggcagtaacggaaaatatctcctgctttcctcgcttcaggaccccggcaatgtggggacaatcctgcgcaccgccgccgcgtttgggacggacggcgtcattttgtcggcggactgtcccgacctttacgcgccaaaggtactgcgcgcatccatgggcggcgtgttccgcgccagggcttgcgtttcggacgatctgtccgcttcgattgccgctctgcgcgcggccggcgtgccggtttgggcggcgatgccggcggaaggctctgtttcgctgcgggatatttcgctgcatggcggcggcgcggtcgtcgtcggaaacgagggcggcggcatcgcgccggagcttgcggcgctctgcgacggtgcgctcacgattccgatggagccgggctgcgagtcgctcaacgccgcgatggccgccggtgtgattctgtgggagatgtaccgttagaaaggaaggcgcggtatgacggacgtggttttctgggcgtggctgcaggatgcgatcgggcttggcagcgtcagggcggaccggatcatccgggagctttcttcacccgaggcgctctatggaaaaagcgcccgtgagctggaggctttgggcatgtttgcgccaaaggagattgagcgcctgcgcgcaaccacgctcgaccgggcgcgggagcagattaagacggccgagcggctcggatgtatggcgattgggccggatcatcctgactatcccgaagctttgacaaatatcgacgccatgccgtgtatattatatgttaagggttccctgtccggcctttcggacgagcttgtcattacaatggtcggcacgcgcagcgcaaccgaatacgggcttgcgagcgcgtaccgcctttcccatgacctggctgcggccggctgtacggttgtgagcggcttggcaaccggcatcgacacggcgagtcacgcgggtgctttacaggcgtccggccgcacaatcgggctgctggcttgcgggctcgacgtcgattatccgtcggccagcggcgaactcaagcggcgcatcctggatgtgggcggcgcgcttgtcacggagtttccctttgggacgggcgtcaaccgcggcagcttcagtatccgcaaccgtctgctttccggcatcgctgcgggcgttgtggttgttcaggccccggaacgcagcggggcgctcattacggcgcgctatgccctgcaacagaaccgcgatgtatttgccgtgccgggcgagattttcgatccgtcgatggccggatgtaacaagcttgcgcgcgacggggccaaagtggttgtcaacgtatacagcatcctggaggaatatatcggccgattcccaaaacggatcgacgcgcgcacggtcgccgcgaggatcaagagcgcggacagaaacgccgcaaagccgccgcgaaacgcgccgcgccggataaagggcgtcaaggcctgtgcaaagccggccactgcgccaaagcaggccgatgtgccgcgtatggatgacggcgagctggcgaagcggggcgtcaccccgcaggcgcgcgccgtttacgcgcagcttggcgcgcgtgcgctggagcgggatgaattggccgcgctggccggtctgggcgcggctgagacgctttcggcgctcacagagcttgaattgaccggatttgcgcgcgtcgtggccggcggacggtatattccgtcggcgccgggcggcgtttaaagaggattgagaagatacgcgcatgagcgcattataaatagagcgtattgttctgcgggcggctgtttgcgcggcccgggaaaggaatggtttgtttgtccaatcttgtcatcgtggagtcgcccgccaaggcgaaaacgattaaaaaatacctcggcaaggattttgaagtcgttgcgtcgatgggccatgtccgcgatctgcccaaaagcaagttcggcgtcgacgtcgaccatgatttcacaccgatgtatgtcgatatcaagggcaaggaggatctgatcaaggatcttaaaaaggccgccaaaaaaagcgacgcgatttttcttgcaacggaccccgaccgcgagggcgaggcgatttcgtggcatctggcgcagatgctcggcgtcgatatgaaccagcccaaccgtgtgaccttcaacgagatcacaaagtcgggcgtcaaatacggaatggatcatccgcgcatgatcgatgtcaagcttgtcgacgcacagcaggcgcgccgcgtgcttgaccggattgtcggctataagatcagcccgtttttgtggcgcaaggtgcgaaagggtctgtcggccgggcgcgtgcagtctgtggcggtgcgcatcatcatggaccgcgaggaggaaatccgcgcgtttaagcagcaggaatactggagcatcgacgccaagctcgcggcgaagggccatgccaaaaagccctttccagcaaagctttatgccatcgacggcaaaaagctcgagctgacggcgatcccggacgaaaagcgcgccagggagatcgtcgagtcgctcgatggagcggactatattgttagtaacgtcaaaaagggcgtgcggcgcaaaagccctgcgccgccgtttatcacgtccacgcttcagcaggaggcgtcgcgccgcctgggctaccagtcgcggcgcacgatgaaggttgcgcaggagctatacgagggcgtcgagatcgaaggcatcggcgcgacgggcctgatcacctatatgcgtactgattcgctgcgcatctccgacgaggcggccgaacaggcgaaaatatatataaccgatacctacggcaaggagtacctgcctgcaacgcggcgcgtttttaaaacgaaaaagaatgctcaggatgcgcacgaggcgatccgcccgtccgatccatcgctgacgcccgaccgcgtcaagaaggatttgacggctgaacaatataagctttataagctgatctgggagcgtttcatcgccagccagatggccaacgccctgctcgatacggtggcggtcgatatcgaagcggccaattgtctgtttaaagcgtccggcttcacggtgaaatttgacggttttacggttctctatgaggagtcgaaggacaccgacgatgagaatacggcttcactgccgccgctggaagcgggcaatgtgctgacgctcaaggagctgacgccgaaccagcacttcacacagccgcccgcgcgctacacggaagcgtcgctgatcaaaacgctcgaggaaaacggcatcggccgtccgagcacctatgcgccgacgatcacgacgattctggcgcgcggatatgtcgagcgcgaaaacaagtcgctcaagccgacggcgctcggagaggttacgacgaagctgatggaggagcagtttgccaagattgtcgacgtgacatttaccgcgaatatggaaaagacgctcgacgaggtcgaggaggggaacgtcgattatccaaagatgctcagcggcttttacgacgattttatgacgacgctggagcaggctgaaaagaatatggacggcacgcgcgtcaaggtgcccgacgaggagacggatatcgtctgcgagctgtgcgggcgcaaaatggttatcaagacagggcgcttcggcaaatttttggcgtgtcccgggtttccggagtgccgcaatacaaaaaagatcgtcaaggaaacaggcggcctgtgcccggtctgcggcggcaaggtgcttgccaaaaagtcgaagaacggcaagggctactacggctgcgagcacaatccccagtgccagtttatgacctgggataagccgctctcggaaacgtgcccaaagtgcggttccacgctgttccaaaagacggggcgcggcgccttgatccactgtctgaaggaaggctgcgattatgcgcgtccggtcaaaccgaagaaggaagcggacgaatgacggttcacgtaatcggcgcgggactggctgggtgtgaagccgcatgggcgctggcgaatcagggaatccgggtgtgcctttacgagatgaagccgcagcggttttcgcctgcgcatcacagtgagcagttcgccgagcttgtgtgttcgaattcacttaaggcgcgcaggcttggctcggccgccggtatgctcaaggaggaaatgcgcatgctcggctcgctgacggtcgcttgcgccgaagcgacgagcgtagcggccggcggggcgctcgcggtggaccgcgacgccttttcggcgctcgtgacaaagcatatccgcgcccacgctttgattgaggttgtgtccggcgaagtgacggatatcccgcttgaccgtttgacggtgattgcaaccgggccgctcacatcggacgcgctcgcggcgcgtatttccgaattgtgcggcgggacgctcagcttttacgacgcggccgcgccgattgtgacatatgaatcgctcgatctggacagggtgtttttcgccgcgcgctatgatcgcggagacggcgactatatcaactgcccttttaataaagaggagtacgaggcgttttatgaggcgctgcgcacggccgagcctgcgccgctgcacgactttgaccaggctgaaaaacgtgtgtacgagggatgtatgccgattgaaatcatggcgcggcgcgggccggatacgatccgctacggcccgctcaagcctgtcggcctgcgtaatccgcgcacaggccatcgcccgtgggcggttgtgcagctgcgccgcgagaacagcgcgggcacgctctataatcttgtcgggttccagacgaacctgcgctttggagagcaaaagcgcgtcttttccatgatccccggccttgcgcacgcggaatttatgcgctacggcgtgatgcaccgcaatacgtttatcgggtcgccgtggctgctcgatgaaacgatgcggatgcgcgagcatgaccggatttattttgccgggcagatcaccggcgtggaaggatacatggaatcggcgatgtcgggcatcctgacaggcaggcagattgcgcggcgcttacagggaaaagagcctctgaagctaccgcttgactgtatgtgcggcgcgctgctgcggtatgtttccgggcctgcctgcgccgatttccagccgatgggtgcaaatatggggcttctgccgccgcttgacgagcggatgaaggacaagcagcagcggtatctgctgatcgcgcagcgggggcttgcccatctcaggcagacactggttgacagtcaggaggttataatggtatgagggtgattgtggacgccttcggcggcgataacgcgccgcttgaaatcttgaagggctgcgcgatggccgtgcaggaatatggggtcgatatcattgcgtgcggaagcgagcgcgtgatacgcgacgtatgtgaaaaaaataaaatttcgctcgaccgcatttcgatcgctgatgtggaaaaggtcatcccggttgaggtcgactcgaccgagatcgtcaaatcatacgacgactgtacgatggcggtcggactgaagatgcttgccaacggcgagggcgacgcgtttgtttccgcgggcagcactggggcgattgtcgtcggagcgtcgctgtttgtcaagcgcatcaagggtatcaagcgcgcggcgctcgcgacggtgatcccgtcgcagaacggctgctatatgctgctcgacatgggcgcgaacacggaatgccgtccggagatgctcgtgcagttcggcattatggggagcgcgtatatggagcacgtcatgggcgtcaagaatccgcgcgtcggcctgatcaacatcggcgcggaggagacaaaaggcatggaattgcaggtgcaggcgcatcagcagtttcaaaacgcgccggtcaatttcatcgggaacatcgagccgcgcgaccttccgtttacacgctgcgacgtggcggtggctgacggctttacaggcaacatcgtcctcaagctgacagaggggcttggctcgtggttcgcaaaggaattaaaaggcgtattgctgcgcaatttcgtctcaaagattggcacgctgtttgtagccaagggcgttgtggagttcaaaaaaaagatggactacaccgaatatggcggcgctccgcttatgggcatcacacgtccagtcatcaaggcgcacggcagctcaaatgccaaggcgtttaaaaacgccatccgtcaggccaaggaatacaccgagcgcggcgtaatcacggagatcgtcgattcgctcgcgcagctcaaggcgcgcgggggcgccggcctgtgaggcccgggcaggagggcgcgtccgcaagcgcgctggagggccgtatcggttatacgtttcaaaatgggcggtatctcgacattgccctgacgcattcttcgtatgccaatgaagtaaaaaagaatatttccagcaacgagcggcaggaatttttgggtgacgcggtgctgtcaattgtcgtgtcggactacctgtttcatacgtatcatctggcggagggcgacctgacaaagctgcgcgccgcgctcgtctgtgaaaaatcgctgtgggaattttcacaggcgctcggtctcggcgattttctcaaactcggccgcggcgaggagatgatgggcgggcggacccggccatcgattctggccgacgcgtttgaggcgctgatcgcggcgatttatctcgacggcggtatcgagcctgcgcgcagatttgtgctcggttatatcgtcgacgcgctggaaaaccgcgacgatctggcattcagcgactataagacgatgcttcaggagatcatccagaaaaatccggaggagaggctttcctatgtgcttgtaaatgagtcgggacccgatcacaacaaaaagtttctggtcgaggtgcggctcaacagcaacgtgatcggcgttggctgcggcggcagcaaaaaaagcgctgagcaggcggccgcgcgcgaggcgctcaagctgatgggccgatgaagcacgccaacgtttcggtgtttgtgccgcacgcgggctgtccgcatcagtgcagcttctgcgatcagcgcgccatttcgggcgcgcaggccgcgcccgacggcgcggctgtggccgcgctgtgcgcgcgggccgaaggggagcttgcgcagaagggacgaacggcgcagatcgcgtttttcggcggcagctttacggcggtaccgcgcgcgtatatgattgaactgctggaagcggcgcggccgtttctcgggcggggcgtgtttacgggcgtgcgcatatccacgcggccggactgtatcgacgatgaaacgctcgatacgctcgcgcgctatggtgtgacggccgttgagctgggcgtgcagagcatggacgacacggtgctttccaaaaatgggcgcggccacacggcagccgatacgaaccgcgcgtccgcgctggtccgggcgcacgggctggaactgggccttcagatgatgacggggctttacggcgcaaacggggcgtctgatctcatgtctgcgcgcctgatcgcggcgcttatgccggcgacggtacgcgtctatccgacgctcgtgctggaggggacgcggctcgcggcgctttggcgcgcgggcctttaccgcccgcagacgcatcaggaggcagcggcgctcggcgcgcgtttgctcgaattttttgagacgcgcggcatgcgcgtgatccgtatggggctgcaagcgcagccgtcgcttgccggacatttgcttgccggaccgtatcatccggcgtttcgggagctgtgcgagggcgcgctcatgtacgaacgcgccgaacgcctgttaagcgagcggccgccgggacggtaccggctgcatgtcgcgccgaaaagcgtatcaaagctgtgcgggcacgggacgcatccggcccagcggctgcgcgctgagggatatgatattaaaatcaggccgaacgccgatgtgcgcggccttgatgtcaaagtggaggatgtgtagtttgcggcttcgcggtttggagatacagggatttaaatcgttcccggacaaaacaaggctgacctttcacgatgggatcaccgctgtggtcggcccgaacggaagcggcaagagcaacattgccgacgcggtgcgatgggttctcggtgagcagtcgacgaaaacgctgcgcggcggcaaaatggaggatgtgatcttcggcggcacacaggcgcgcaagccccagggctacgcccatgtgcagcttacgattgaaaacgcggacggcgcgctgccctatgacagcgccgaggtgagcgtttcgcgccgtctgtaccggtcgggcgaaagcgaataccgtatcaacggcacgagcgtgcggcttcgggatgtacatgaactgtttatggacacagggcttggacgcgacggatattcgatcatcggacagggccgcattgcggagattgtgagcgccaaaagcacacagcgccgtgagatctttgaggaagccgccgggatttcaaaataccgttaccgccgtcaggaggcgcagcgccgcctggaggccgctgaggaaaaccttctgcgcctgcgcgacatcctggcggagcttgaagcgcgcgtcggccctttgcaggcgcaggcggaaaaggcgcgccggtttttaacgctggcagaggaaaaaaagacgctggagctgtcgctttggatcgcgacgctcgaccgctcgcgggcgcttctgcgggaacaggaggacaagctcctgttgtgcagggacgatcatgaccgcattcaggcggaaatggacgcggtggaacagcggatcaacgccctgtatgcagatatgcaggcgctcgccgttgagatcgacgaacggcgtgcgcaggcgcggacgcttgaggaggaaaatgcgaacagcagtgcggacatcgcggtgatgcagaacgatctggcgcataaccgcgcttcaatcgaacagatcggcgcggaactgcggcaggcggatgctgacggcggcgggcttgacgagcaaatccgtacatatgaaacggagattgcggacaaacaggcggcgctggagaaactgcaccgtaaacaggaggagacgcagcaggagattgtgaggctgacagccgcccgcgaggactgccggacacgcgcggacgcgcttaaagaacggcgcttcgggcttacgcagagcatccaggaggcgaagctgtcgtcggcgtcgagcggatcgctgattgacgagacgattgcgcggcttgaggcgcttcgggacgcggcggttgtcggcgatgaaaatgcggcgcggatcgaaaaggagcttgcggactgtaagggattgctcgccgaggtgcttgcggcgtcagaatcgctccaaaatacgcgccgcggttatctgctgcgcgccgaggggcgcggcgagaagctcgacgcgcttaaaaagcagcgcgccgcgctcgatgaacaggcgcgcggcttcttacagaaggcgcggctgctcaccgatatggaaaacagcctggagggctttcagagcagtgtcaaatatgttgtctcacaggcgcgccggggcgcgctgtccggcgtgtgcggccctgtctcgaagctgattgaagtcgatggggaccatgcgctggccattgaaatcgcgctcggcgcggcgatgcagaatattgtcgttgaggacgaaacggccgccaagcgcgcgattgcgatgctgcgctcgagcaaaacagggcgcgcaacgtttttgccgctgacaacggtgcgcggcgcacggctctcggagggttggctttcctccgctgatgggtttgtgggtatcgcggccgacctggtgcggtgtgacagccgctatgaaggcgttgtggcgcagcttctcgggcgtatcgccattgtgcgcgacatcgactgcgctgttgcgctggcgcggcgcggtgggtataaattccgcgttgtgacgctcgacgggcaggtcgtcaacgcgggcggctcgatgaccggcggctggacggcgcgcagcgcgggaatcctcagccgcgcgcaggagattgaatcactgcgcgcgcaggcaaaggactgcgcggatcggatggagcgcctcgatggtgaaatcaagaccgttcaggaggagctttccgccgcgcaggcggcgatccttggcgtcgacggcgagcttgccacggcgcaggaggaccgcatccggtgtgaatcggagcagaagcgtttattggctgcgcaggcggatgctgcgcgcgtccgtgagcaggcggccagggagtatgaggcgctcgaagcccggctgcgcgaactgcgcgccgccggcgtatcagccgacgggctgatacaggagctttccggccagcttgacgaggtagcgcggcagcttggagaagtgaacgagggacgcgacgcgtatgcgtcgcggcttgatcaggcgtcggaggcgctcgcgcaggttaacgtcgccgcagcggcgcttgaaaaggagatcgacggagcgcgtctgatgatggaacagctcgccggacagaaggagcaccgccgggagcaggagcgcgcgctgaaggaacgcgccgcgcgtcttgaggaggaaaacgaggccgtccggcagaggatcagcgatctggaggccgcgcgcagggaacggaccgcgcggattgaaaccattggaacggagattgcagagcgcacggcccggcgcaacgagtgcgagtctggtaccgccgcgctgcgcgcggacgaaaaagagatcgccgcgcggcgtgagacagccgcgcgggaactggcgcgcctggaagaaaaaaaggcgtcgatgcagggcgaatacgacgcgatcatcgcgcgcatgtgggacgaatatgaggtgacgcgttcgcaggccgccgaactggcgcagccggtggaggatacgccggctgcgcagaggcgcctgggggaactcaaaggtaagatcaaggcgcttggcagcgtgaatctgggcgcgattgaggaatacggcgaggtgtcggagcggtatacgtttcttaagacgcagacagaggacgctgagcggtcgcgcgccgagctgctgcggctgattgagcggcttacaagcgatatgcgcacaattttttcggagaacttcactaaaattgccgcgaatttttctgtagtttttacagagctgttcgatgggggcaaagcgtccctgtcgctggcagacccgacggacgtgctggaatcgggcattgatattttcgtacagccgcccggcaagatcattaagaacctgtcggcgctttcgggcggcgagcaggcgtttgtggcgattgcaatctattttgcgatcctcaaggtgcggccgtcgccgttctgcctgctcgacgagatcgaggcggcgctcgacgatgtcaacgtcgtcaaatacgcgcaatatttacgcacgctctgcgataaaacgcagtttatcacgatcacgcaccgccgcgggaccatggaggaggccgacgtgctctatggagtgacgatgcaggaggaaggcgtttccaagctgctggagctgaatgtcggggagatcgagggcaaactcggtatccaataaaacaggaccgggagggacaatatgggttttttcgggagactggccgaggggctgaaaaaaacgcgcgaatcgatggcgcgcaaggttgacgcgattgtcaattcgtttacaaagattgatgaggagctgtttgaggaactggaggagacactgatcatgtcggatgtcggcgttgcgacctccgcagagatctgccgccgtctgcgtgcggctgtcaagcagcgcggcgtcacggacgccgccgaggtcagggagctgatcaaggagatcatcgcagacatgctcgccggcggtgaggcgctctcaatttcaacaaagccgtcgatcgtgctcgtcattggcgtcaacggtgtgggcaagacgacgaccatcggcaagctggcggccagccttaaagcgcagggcaagcaggtgctgctcggcgcggctgacacgttccgcgcggcggcgatcgaccagctccaggtttgggcggaccgcgccggcgtcgagatggtacgccagtcggaaggggcagacccggccgccgtcgtgttcgacgcgatcaccgccggccgcgcgcgcggcgtggacgtgatcatctgcgatacggccggccggctgcacaataagaaaaacctcatggacgagctgtcgaaaatctcgcgcgtgatccagcgcgaggcgcccggctgcgacgtcgaggtgctgcttgtgctcgacgcgacgaccgggcagaacgcgctcaatcaggcgcgtcagtttaaagaggccgcgggcatcacgggcattatcctgacaaagctcgacggcacggcgcgcggcggcgttgtcatcggcatccggcaggagcttgaggtgccgatcaaatatatcggcgtcggcgaacaggtcgacgacttgcgcccatttaatgcagccgactttgtcgacgcgctgttcggcggccgggaaacggaggcggatgattgatgcaggtgatcgccgcgacgggaaaccgtcataagttacaggaatttgaacggattttcgcgccgctcggcattgagatcgcggcgcagagcgacgtgtgcccggcgctcgcggtggaggagacgggcgaaacctttgccgaaaacgccttcctcaaggcgcaggccgtccacaggctgaccgggaaggccgccgtcgcggacgattcggggctgtgcgttgatgcgctcggcggcgcgccgggcgtttattcggcgcggtacggcggagaggatctgccgcacagcgagaagatcaaactactgctcaaggagcttatacaggtgccggatgaaaagcgcacggcgcgctttgtcgcgcatatctgctacatcggcgcggacgggacgcgcatcgacgcggaggaatgctgcgaaggcgtcatcggccatgcgccgcgcggggagggcggcttcggctacgatccgattttcatggttggggataaaagcttcgcagagctttccggcgcggaaaaggacgcggtatcccacaggggaaaggccctgcgcgcatttgcacagaagctttcgcagggatgcgggaatcaataaagaaatgaggaaaccaagatgctgacaagcaaacagcgcgcaaagctgcgcgggctggcaagcacggaggacaccattttgcaggtgggcaagggcggcgtggcggacacgctggtcaggcaggtcgacgacgcgttaacggcgcgcgagctgatcaagctgcgcgtgctggaaacgtgcccggagtcggtgcgcgaagcggccgaacggctggctgccgcggcgaacgccgaggtggtccaggtgatcggcggaaaatttgtcctgtaccgcagaaacgacaaaaaaccgcggatcgagcttgactgatgcgcacgggcgtgttcggcggtacgtttaacccgatccattgcggccatgtcctgcttgcgcggacatatgccgctgcgctccatttggatcgggttttggtgatcccgacctatctgccgccgcataaggcgggcggacagcttgccggcggttgtcaccgcctgaatatgtgcaggctcgcgtttgagggcgacccggtctgccgcgtcagtgacattgagcttcgccgcggcggcaaaagctataccgtcgatacgctcaagcaacttacgcgcgaaaatcccagcgatacgttttacctgattatgggcagcgatatgtttttatcgctgacacaatggtatgactggcagaggattattttggacgcggtgatctgtgcgggcgcgcgcagcccgggacagatgcaggcgctgcgcgccgaggccgcccggcttgagcggctcggcgcgcaaatcgagctggtcgcgctcgaacctctgccgttttcatcgacacaggtgcgcgcgcgcgtgcaggcaggcgagagccttgcgggatttgttccgccgaaggtggcggattatatcatggaaaacaggctgtatcaatcatccaaggggctgttttaaagctcccgttacggggcaaaatgcagcccccgattctcaatgaaagcggggcgcgtcatgatggattatgatttgaaaaagctggacaaacttgcgaaaaagaccctttcggcaaagcggtatttccatacgcagtgtgttgtcaggcaggcgcagaagctcgcgcgcctgtatggctgcgacgaacagaaggcgatggccgcaggctggatgcatgacatctgcaaggagatgccgcgcgatgagcagttgcattggcttgaaaagtatggtatcattcttgacagcgtacagaggacccagccaaagacatggcacggtatggcggcgtgcggctatatcagggagacgcttgggatcgatgatcctgaaattcttcacgccatccgctaccatacaaccgcgtgcggcgcgatgaccgcgcttgacgaggtggtgtatctggctgatctgacaagcgaggaccgcgattataaggatattctgccgatgcgcgcgctggctgaaacggcgctgcgtcccgcgatgaaagaagcgatgcgctttgccctgcgcgatctggtagaacgctcgctcggtatcagccgggatacatttgaggcatataacgcttatataacagatcagcaggctgatctgaaacgtccgtctggaggtgaaacggatgacatctaatgagatggttaaaaagattgcgcgctttctttcggaaaagaaggccaaagatattatggcgcttgaaatccgcgaattgacgacgatcggcgattatttcgttatcgcttccggcggttcggatacgcaggtcaaggcgctgtcggacgccgtggaggagggtctttccgcgctcggcgaggaaccgcggcgcatcgagggctatcagtcggggatgtggattgtgctcgattattacgacgtgatcgtccatatattccacgagcaggcgcgtgaattttacgggcttgaacgcctttgggccgacgcgcccagggtggaactggcgcccggttgagcgcgcctttgacggtccgatgaccggggggccgctggcggctccggttgcaacagaatttgccgcgggcgttttgcggcggcggggagtgtacaaattgaagtacgatttcgcatcgattgaaaagaaatggcaggatatctgggaggcacagggcacgtttgcggcttcgaacgactatacaaagccgaagtattacgcgcttgtggagttcccgtatccttcaggacaggggctgcatgtgggccatccgcgctcctatacggcgctcgatatcgtggcgcgcaagcgccgcttcgagggctacaacgtcctgtacccgatggggtgggacgcctttggcctgccgacggaaaattacgcgatcaaaaaccacatccacccggagaaggtgacgcacgacaatgtacagcggttcaaggcgcagctcaaaagcctgggactcagcttcgactggtcgcgcgaggtcaatacgaccgacccgtcctattataaatggacgcagtggattttcctccagctctttaaacgcgggctggcgtataaaaaggagatgtcggtcaactggtgtaccggctgtaaggtggtgctggccaacgaggaggtcgtaaacggcgtctgcgagcggtgcggcagcgaggtcgtccacaaggtcaagagccagtggatgctcaagattacagagtatgcgcagcggcttttggacgatctcgatacagtcgattacatcgaccgcgtcaagatttcacagcgcaactggatcggccgttcgacaggcgcgcaggtccatttcggtacgacggccggcgatacgctgaccgtttatacaacgcgcccggacacgctgttcggcgcgacgtatatggtcatctcgcccgagcatccgtatatcgaaaagtgggcggaccgcatcggaaatctggacgcggtgcgcgcctaccagcaggagtcggccaagaaatccgactttgaacgcaccgagcttgtcaaggataagacaggcgtccgcctggagggcgtctgcggcgtcaatcccgtcaacggggccgaaatcccgatttttatatcggattatgtcctgatgtcgtatggcaccggcgcgattatggccgtcccggcgcatgatacgcgcgactgggagtttgccaaaaagtttggactgccgattatcgaggtcgtgcagggcggcaatgtcgagcaggaggcatacaccgactgcgacactggcgtcatggtcaattccggaatactcgacggcctttcggtcgaggaggcaaaaaagaagatcatcggctggctttccgaaaataaaaagggcgagccgaaggtcaacttcaagttgcgcgactgggtcttttcgcgccagcggtactggggcgagccgatcccgatcatccactgcggccactgcggatatgtgccgctcgacgaaagcgagctgccgttgcgcctgccggaggtcgatagctacgagccgaccggcgacggtgattcgccgctggccgcaatcgacagctgggtcaatgtcaagtgcccgaaatgcggcgcgccggctaggcgcgaaacggatacaatgcctcagtgggccggttcgtcatggtatttcctgcgttactgcgacccgcacaacgacaaggagctggcctccaaagaggcgctcgactactggatgccggtcgactggtacaacggcggcatggagcacacgacgctgcatttgctctactcacgtttctggcataagtttttgtatgacatcggcgtcgtgtcgacgccggagccgtatgccaagcggacaagccacggcatgattttgggagagaacggcgaaaagatgagcaaatcgcgcggcaacgtcgtcaatccggacgatattgtgcgcgattacggcgcggacacgctgcgcctttatgagatgttcatcggcgactttgaaaagagcgcgccgtggtcgcagagttcgatcaagggctgcaaacgctttctggagcgtgtgttcggcctgcttgactgcctggaaccgggcgaagcctattcgtctgcgctcgaatcggcgctgcataaaacgatcaaaaaggtgacggaggacattgaatcgctcaagttcaacacagcgatcgcagcgatgatgtccctgcttaacgatgtctgcgaccatgggaaaatcaatgccgcagagctgaaaacactgctgatcctgctcaacccgttcgcgccgcacatgaccgaggagatgtgggagcgagctggcttcggcgggatgctcaatggtcagaagtggcctgtgtttgatccggccaaatgccgtgacgcgcaggtggagatcgcggtgcaggtatgcggcaagatcaaggcgcgcgtcatggtcgacgccgattgcagcgacgatcaggcgctggctgcggcgaaagcgcgtccggaggtcgcgcgcgccatcgagggcaagacaatcgtcaaggaaattgttgttaagggcaagcttgtgaatattgtggccagataaactttttgtataattttgttgaaaagccacaatagaacatagggtaaattgcttgacaaaggatacctcgtcatagtataataaaagctgttatccaaccacaacggaaggattgacagagtcaggccagacggcgtggggagggaattggtaaatgtcagaaatcagaatcaaggacaacgagtctttggacagcgctctgcggcgttttaaacgctcctgcgcccgctccggcgttcttgccgaagtccgcaagagagagcattacgagaagccttctgtaaagcgcaaaaagaaatctgaggctgcccgtaaacgcaagttcaaataatcaagcgataaaaacggatggggcgcgtccccatccgttttgttcattgcaggttggccgcgccgcggccggaaacgagggaaactatgcgcctgttttggccggaatacaggttccagcgcgcctggcagatcacgcccgaatggcttgcccggcatgggctgaccgtactgctgctcgatgtcgacaacacgctgacaacgcatgacagccccgatatcgggccgcaggcgcgcgcgtggatcgcacagatgcagcaggcgggcgtgcggctcctggttctttcaaacaataaacccgcgcgcgtcgaaccatttgccgagatgatcgggcttgggtgtatcgccaatgcaaaaaaacctcttggcggcggcgtgcgccgcgcgcttgcgcgtctgggagcgaaaaaaagcgagctggcggttgtgggcgatcagatctttacggatgtgctgtgcgcacgcctggcgggcgtgacgtcagtgctggtcgacccaatcgagctggaaaccttcccgtttttccggttcaagcgcgcgcttgaacgtctgatcctgcgcggcgatgcgtccggcgcgcgtcgataaagcatgccgggcggcgatttttaatcgatgggacataaaggggtgtcatcatggaaaaactgcttgtgatcaatgggccaaatctgaatatgcttggcgtgcgcgagcctggtatctatggaaataccggtttggaggcgatcagcgcagaactgagggagtatgccgccgcgcgcggcgtccattgtgaattttttcagtcaaatcacgagggggatattgtcgataagctgcagaaggcgcacaccgattttgacggcgttgtgctcaacgcgggcgcgtacacgcattacagcatcgccatccgcgacgcgatcgccgcaatccgtacgccggttgtcgaggtgcatctgtccaatatccatgcgcgcgagccgttccgccatacgtcggtgattgcgccggtgtgcgccggcggcgtctatggctttgggaaaaacgtctacaggctcgcggtcgacgcgctgctcggcatggaggaggatcacaatggaaaacaggactgaggcgctgctggaacggcttccgaaggaaattgaaggcgtattgattacatccgaggtcggccgccgctatttgacagggatgcagtcgtcagccggcacattgctggctctgcgcggcataggagcgtatctgatcatcgatttccgctattttgaaaaagcgcgggccgtttgctccggctgcgaggtgattttgcaggacaagctttacgggcagatcggggaattgctcaagcggcacggcgtccggcggctggcggttgaaagcgactatatgacgctcgcggagtatgcgcggtggaaagagcgcctgccggatatcgagctgttttccgacgcgcgcgctggtgaagcgctgcgcgccctgcgggcggtcaaatcgccgcgggagctggcggctatccgtgcggcgcagaaaatcaccgacgacgcgtttacgcatatctgcggctatatcaaggcggggatgaccgaccggcagatcgcaggtgagctgctcgattatacctaccggcatgggtcggagcgtccggcgttcgattatattgtcgtatcgggcgcgcattcctccatgccgcacggcgtgccgacggacaagaaagtcgaaaagggcgattttatcacaatggatttcggctgcgttgtagacggctattgctcggatatgacgcgcactgtggcaattggccaggtcagcgaggagcagcgccatgtttatgatatcgttttgcaggcgcagaaagcagcgatcgctgcggtgcggccaggcgctgtctgcggcgatgtggacgcggcggcgcgcggggtcatcgctcaggcgggttatggcggcgccttcggacatggtacgggccattcgctcggcctggaaattcatgagacgcccgccttcgctccggaaaacacccatatctgcgcgcccggtatggtgatcaccgttgaacccgggatttatctggaggggcggtttggcgtgcgcactgagaatatggtgcttgtaacgcaggacggctgcgaggatttgacatcatctgacaggaatttgttggtattatagcaagaattatgtgagaaaggggcttgcattcggcgcctttttcatatagaattagagtgttaaacagggtgatgcgcccaagcctgcaggcaggtgcgtcagaacatttggaggtaactatatgatttctgccggcgatttcagaaacggcgtgacgttcgagatggacgggaacgttgtacagattattgaattccagcatgtaaagcccggaaagggcgcggcgtttgtccgcactaagatccgcaatgtgatctcgggcgctgtgacggagaaaacgttcaacccgacggacaagtatccgactgctttcgtcgagcgcaaggacatgcagtatctttacagggacggcgatctgtattactttatggataacgagacgtatgagaatattccgatctcggcttccacgcttggcgacaacttcaagtttgtgaaagaaaacatggacgtgaaggttttgtcgtataagggtaacgtgttcggcgtcgagccgccgtttttcattgagcttgaggtcacacagaccgatccgggctttaagggcgacacagctaccaacgctacgaagccagcgacgcttgagacaggcgcggaaatccgcgtgccgctgtttatcaatgagggcgaccatatcaaggtggatacacgtaccggcgagtatatggagcgtgcgtaagcgccgcttttccataaacatttgaaacgaatggaggttgacagccatgacgattacggagagagccgcgtatatcaagggtcttgcggaaggactgggcatcgacgattccaccaaggagggaaaggtcatcaatgcgttggtcaacgcatttgacgacatggcgctgaccgtttccgacctcgaagcccaaatcgacgaactcagcgaacaggtcgatacgattgacgaggatctcggctcactcgagcaggatttttacgagcttgatgacgacgactgcggctgcgatgactgcgactgtgacgacgaggactgcgcagacggcgacatttatgaggtctgctgcccgacctgcggcgatatcgtatgcatcgattccgatatgcttgaggaaggccagacgacttgccccaactgcggcgagcttctggaattcgacctcgatgatgaggaagatggggacaaggcgtcgtccgagcaggacggcaagtaattgttgtctgcatatcaagcgtttggctttgaaccggaagacaccccgcctcccgcggggtgttttcgattgattcactgaaaggatttttgggcttgtcgaagcgtgaaaaactgggcagggcggtcgcctgccttctgattgcagcggtcctgttggctggcctggcgggttttgttgccagggcattggcgcagcggcgggtctctgagagcgaacgcatggtaacaaccggcgtggcgtttattatggatacgttcgttgagtatgaatttttcggcgagaacggaccgcaagccaaggatgcggtcgatgctgccctgcgcgatatcgaaaacaggatgtcgatgtacatagatgattcggagattgccgcgctcaatcgaaatgctggaagggcgttcgtaccgctttcagaggatacgtatgagctgttggaacgctgcgcggcgtatggggctgaatcagacggcgtttttgacgtaaccgtcgcgccggtggcgcaggtttgggggatcacacgcggccgcgtttttatcccggacagcgagcagatcgccagccggctggctctggtcgattaccgcgatattctgctcgatcctgagacgcattccgcgatgctgcggcgtgagggtcaagccgttgatctcggaggaatcgccaagggatttgcatgcggcgcggcggaccgcattgcgcgggagaacggcgttgaatcgggatttatttccatcggcggcaacatcatgacaatcggccaaaaacctgtcgcggatcaggctggcagaacagtgagacagccgttccggtttggcctgcgggacccgcgcggcggtgaaaacgattatattgccgcggtcgtcctggaggacactacgatggccacgtccggcgattacgaacgctattttatgaaggatgacgttcgttatcaccatatcctggatcccgcgacgggttatcctgcccggacggacctgatgtctgtgtctgttgtttcgcaggatggcgcgtttgctgatttcatgtccacatggctgtttataaagggccggtcgtttgtgctggagaggctcaacagttttgactgcggcttgatcgtgattgatcaggacaagaatgtctatatttcagaaaatatgcgggagcgtgttgtcccggccgacaagagcggtgcctatacgtttgtatccggagggacggcatgaagtaccgggcgtcgcgcgcggcggcaatggggcttttattcgcgctttcgattgttttaagtttcgcggagtcggccttgataccgcccctgccggttccgggtcttaaaatagggctttccaacatcgtgacgatgtactgtctgttctgtatgggccggcgcgaggcatatatgatcgctgtgctgaaaagcatgtttgtgctgtttacacgcggcgctgtcggcgccgcgatgagccttgcgggcgggctggcgtctgtgacggtgatgctgctgctcggcgcggagcgtgaaaagcgcagctttctttttataagcgtctgcggcggtttggcgcacaacgccggacagctctttatggctgcggctgtgctgaaaagcgcaatggtgttttattactttccggcgcttgccctctttggaatcgccatgggggtattgacaggagtactgctgcgcagtctgatgccgcattttaaacggatcttcttttgacgccattttggagtcaactgacgataaagcccgtatcaaagcggcccttgaacggcccgcctgcttgttgtgtgggcagggcgggaatcaaaggccggtttacggggggaagctgccggggcatggcggtttctgaaatctctagaggaggcaatatgggaaaatgagtgttttgcagaaaacgctgaagggcgcgcatgtcgcgcacttcaaaaacacggaaaattgtccgggcgttgagctgccgcttcccaaggaagtatgcatttcaatgtcgcagcacatgggtccgccctgcaagccgatcgtggccaagggcgacactgtgaaggttgggacaaaaatcggcgacagcgacgcatttttaagcgcgccgatccattccagcgtatcggggactgtttcggcgattgaggagatcgtcacatcgaacggcgggcgcagccaggtggtgatcatccagacggacggcgaacagacggtcgatgaaaatgtaaagcccccggtgatctcaaatcatcccgaatttgtgcaggcgatcaaggagtcgggccttgtcggtctgggcggcgccggtttccccacgcacatcaagctgaatcccaagaatctctctgaggtggatacgctcgttgtcaacgcggccgaatgcgagccgtacataacatccgactaccgcacgatcatcgagcgtccgcaggatgtgctcgacggtattgaggcgatcaaaaaatatgtcggtattacacaggtcaagatcgccattgaggacaacaagccccaggcgatcgagatgctgcgccgtctgacaaaggacgacagcagcattgaggtgtgcagcctgcacgcgatttacccgaagggcgctgaaaaggtcgcggcctatgagacgaccggacgcgtgatcaaagaggggatgcttccagccgacgcgggtatcatcgttgaaaatatcacaacgaccgcctttatcggccagtacctgcgcacgggtatgccgctcatcacaaagatgctgacagttgacggcggcgcgatcgccgagccgaaaaacgttatcgccccgatcggcgcgcatttttccgatgtgattgccttctgcggtggctacaaacgcccagccaaaaagctgatcatgggcggcccgatgatggggacgcttgtgtttgacgccgcgtaccctgtcctgaaaaacaacaacgccctgcttgcgtttgacgagtcgcagaccgtcgtggagccggaacatccatgcatccgctgcggccgctgtatgcagaattgcccgtatcacctgatgccgcgccagatcgagaaggcatatgagagcgagaacatcgcaatgcttcaaaagctcaaggtgatgctgtgcatggagtgcggctgctgctcatttgtctgccccgcaaagcgcaatctgaccttcaccaacaagatggccaagcagatgctgcgcgcggcgactgcaaaaaagtaaggataggagggtattgttttggctacgaatgtaatggaaaaccaggagcagacgcaggaacaggcgaagcttatgatcaccccgtccccgcatgtgaaggatggcatctcgacgcgcaaaatcatgctcactgtctcggtggccctgatgccgtcgctgattgcggcgatctggttctttggcctgcgcgcgctcgcgctgactgccgtctgtgttgtgttcagcgtcctgtttgagtatctgtttaataaggtgacaaagcgcgagcagaccatcggcgattgcagcgccgttgtcacaggcattattctttcgttcaacctgccggttacgcttccgttctggatggcggcgttcggctcctttatggcgattgtcgtcgttaaatgcctgttcggcggcatcggatgcaacttcgccaacccggcagcgacggcgcgtgtgtttctgctcgtgtcgtttggcggccagatgacgacatgggtcgctccgcgcggtgttgacgcgatggcgacggcgacgccgctcacgctgatctcaaccgggcagacggacgcgctcccttcgctttggcagatgttaatcggtcagcgcggcggttcaatgggtgaaacctgtgcgattgcgctgatcatcggcggcgtatttttgatctggcgcggcatcatcggatgggagatccccgtgacgctgatcgcgagcatctttgtgtttgcgctgctgttcggtcaggatccgttttatgcgatcctttccggcggcgttatgatcgctgcatttttcatggcgactgattattcgaccagcccggtaacaacaaagggaaaggtcgttttcgcaatcggcatcgggttcatcaccatggtcattcgctccttctgcaactatccggagggcatgtccttcgcgatcctcctgatgaatatcctgacgccgcacatcgacagcctgacgattaccaagccgttcggcgctgtctttgagcagaaacagtaagggggcgcatgtatatgaaactggcaaaaccgattatcgttctgaccctcatctgcgttatttcttccgcgctgctcggcgcgacctacacaattacaaaggatacgatcgacgcagccaccaaagcggctacggacgcggccatggcggcggtgctgccgggcgccggcagctttgaggagatcaccgtcgacggcgtcgagggcgttctgctcgcggccaaggaaacaggcgggcttggctacgcgttccaggtgcaggataagggctttggcggcgcgtatgttgtgatggtcggcattggcgacgacggaaagatcacgggaacgcagctgcttgacaacagcgaaacaccgggacttggttccaagacgggtgaagcctcctttaccggtcagtttatcggtaaggattccgcgcttgagggcgtcgagacggttacaggcgcaacgatttcctcaaacgcgtttattcgttgcatcggaaccgcttatcaggcgtacggagctgtgaccggtcagtctgttgattcgactgccggcgctacggcagaggaggaggcgtaaatcatgtctgataaaccaaagacaaattattggaaaattcttacaaatggcattctcaaggaaaatccgacgctcgtgctgatcctcggcacctgcccgacgctggccgttacgacccaggcggtcaacggcatcggtatgggcattgcggcgatggtcgttttgatcggctcaaacgtcgttatttcgcttttgaaaaaagtaataccggattccgtgcgtatcccgtgctacatcgtcgtcatcgcggcgtttgttacaatcgttcagtttcttgtcaaggcatacgccccgtcgcttgacacggcgctcggcgtttatctgccgctgattgttgttaactgcattatccttggccgcgccgagatgtttgccaataagaataccgttcttgcctctgctcttgacggcgtgggtatgggccttggttttacactggcgctgttctgcatgggttcgatccgcgagctgatcgggaacggcacctggatgggcatcacgttgacagccaacctgtgggatccggtcatcgtattcctgctggctcccggcggtttcctcgtatttggatttttgatcgcggccgtcaaccatttgacgcacggcaaggcgattaagaaaaaggaattcggctgcacaggctgtccggcggcttctgcatgcgctgctgtccgggaaggaggtgctgatcagtgaagcaatatttgattatcattgtcagcgccgttctggtcaataactatgtccttgcgaagttcctcggcatctgcccgtttttgggcgtcagcaaaaagctggattccgcattcggcatgagcgtcgccgttacctttgtcatggcgcttgcgacagccgccacatggccgatctatacatatctgctcgttccgaacgggttggattatttacagaccattgcgtttattctgattattgctgcgcttgttcagtttattgaaatcgtaatgaagaagtacatccctgcgctgcataaggcgctcggtatttacctgccgttgatcacgacgaactgcgccgtgctcggtgttacgatcctcaacctcgacgaaggctacaatttccttgaatcgatggtcaactcgatcggttccggtcttggctttatgctggccatggtgattttctcgggcgtgcgttcccgcgtagacgctgcggctggaagcattcccaaggcgtatcagggcatcccgatcacactgacggcggctgcgatctgctctgtcagctttatgggcttcagcggaatcgttgacggcctgttcaaataatgggggtggggtttcatgatgacttcaataatgttcccagcggtcatcgtaggcggcatcggcttgatctgcgcaattgtgttggtcgtcgcagctaaggtaatggcgctgcccgccgatgaactgtttgacagtatccgcgccgagctgcccggcgccaactgcggcgcctgcggctacgccggatgcgatgattacgccaaggcggtcgcgcatgacggcgcaaaaacaaacctgtgtgtgcccggcggcgcaggcgttgcggcgaaggtgagcgcggcgatgggcgttgcagccgaaagcgtggaggcaaaatatgctgttgtgcgctgttcgggaaactgctatgcaactgacagcgtgatggattacaagggtaaacagagctgtgcggcctgtaacttcttttatcagggcaagggcagttgttcgcatggctgccttggttacggcgattgcatcaatgcgtgccaatacggggcgatttcgattgtcgacggcatcgctgtgatcgacaaggccgcctgtgtcggctgcggcatgtgcgcaaaggcatgtccgaaccaattgatcacagttatcccggcttccagcacggtctatgtcgggtgcagctcgcacgataaaggcgcgtttacgcgcaaggtctgcaagaacggctgcataggttgtaaaaaatgtgagcgtacctgcgagcatggcgcaatcaccgttacggacaacctggcttcgattgatccggagaaatgcgtcaactgcggaaattgtgtgaccgcttgcccgaccggcgcaattgtcacctgcgaatcccgctgcgaggcgatcgtcaagggcgcgtaatttgcagcgttctggggcttgaaaagtaataacgaatgaggggctgcgccgctttagcggcgcagcccctcattcgtttgttttctgacgtatccggcgcctttggtcaggcggcattcaatacagtgtaccggcaaaaaaggcatcccggaaccaaacgtccaatacctcaaaggaacgtccgttcaagccgtttaatacgcctgcgtccgactggaaatgaaaggtcagcttataagcgcaaagcgcctgatgcttcaatcccgttttgtggttatcgcggtttcgcccatactttgcatcgccgagcagcggatgcccaatatgcgccaaatgcgccctgatttgatgggtgcgtcctgttagcagatcaatttccaaaagtgaaaggcggtccttttgcgccacaacgcgataatgtgtcaggattgtgcgcccatcggggatcggatggtcgtaaacagcgaccgtattggtacgagcatccttgcgcaggaaggcttttaatgtgtcggattccttcggcatcgttccgtgtacaatgcacaggtagagcttttgcagctcgcgcgccttgattttttcattgaggatgcgcaaagctgcggcatttttcgcagcgatgacgataccggcggtattgcggtcaatccggttacacagcgccggtgcgaagctgttttcctccgccggattataaacgccgcagttgtaaagatggtgctgtatacgattgatgagcgtatcgctgctctgatgctcgtcctcatgaacaaccaaaccggcgggcttattgacaagcaggatattttcatcttcataaataatatcgattgcggctggagagcgcaggaaggagaaggcgccgtcgcggctgtcaaaaaaagaatcgttgagatagagcgtgagttgatcgccggtgcaaagacgcgtcgaaatttcacagcgttttccattgagtttaatacgtttggtacggatcgctttatacagcatggactgcgggagcagcggaaccgcttttgtcagaaacttatcgacacgttgtccagcgtcgttaccattgatttgaaattccctcataacatcctccaagctggatttcattttggaccggttttgccatattgccataaaaatatgacagagctggccgtctgagcaaaagcgggttgagttcgtcctgatggcatattttacatgccgcttcgcagacatggtaaaataaccgcagggcggtcattttaccttttatggccggggcgatccgcgggcgcagcccgcttccgccctgatggccaattttaccatgccgcttcgcggacatggtaaaatatgcgcaatgcgcaatccgctgcaaagcagcggttgccgacggatggcggctacaaacggctttatcgtttgctctgcgcatattctaccatgaagtaaccattgcggcaagcgatgaagccggctggatgcttgaaaattggacatgctgcggatataatggaattgagacatcaagaaatgtggtgacacgatggcaaatctgcatgaggggcatcgtcaacgcctgaaagagcgtttcctgcgtgaaggactcgaccattttgagccgcataccgtgctcgagcttctgttgttttacgctgtaccccagcgtgatacaaacgaattggcacatcgtttaatcgcacggtttggctctcttgacgctgtgttcgacgcggcttttgatgaactgtgtgcagtggaggggattgggcgcaacacagcaaccttgctcaaactggtgcccgatctgacgcgtcgctacctggacagtgcggatcatgagcaggtgctgcttacgtccgtccaggcgattggggattttttgcgtccaaaatttttgggacgaacaaaggaaatggtattcctgctttgtctgaacaacaagggcggattgacctacggcgattttatcgcggagggaacaatcgattcagcgccgatgtattcgcgtaccattctggaagccgccatgcgcagccgtgctgtgtccgttattttggcgcacaatcatccgcatggacttgccgtgccatctaatgctgatctggcggcgacggaaagtgtttgccacgcgctcgcagctgcaaagatccgcctgcttgatcattttatttttgcaggacaggattatatttctctgcgcgattcaggctttattcgtgtggaaggcggcgtttaatggattgattcaaaaaagctgtgtaaatgcagctgcctataaaatagcgtcaaaaagtgagctgaaatagggtagttgtcgaacagaatgcaaaaaagacaggtgaaaagtggtcgcttttacctgtcttttcttcctgctgcacatcaaagcgcggctttcaagggggaggatgcccatatggcaaaattattttaaggcttcactttgtgatttaaccgttctttagcttcttcggtggtttcctcctcctttgtgagataacgatcaacataagcgccttcaattttcgtaaaaatgtgggtgaatggcggttgcaaggagacgtccgaagaaaaagagagtattgtccgcagtgaatatcaaggacgttcggcgctgtgagaaccagagcaacgcattgcatattgaaagctctacagtaaaatagtgttttgtccaatgatcggattgacaaaagacatataaagatataatataaaaacaggatatttttaaaaatacgaatagaattgctttttctgtccatttgtatggaacacggaatcgggtgagagtcccggcgagtcggtcactgtgatgcttccaagagaagataagtcagatacgtgggaaaaagcggtgcttctgccgcaaccggaagacacgggccatattggcgtagagcgatctgcgcttttttctgggcgtgcttttcttaggaaggcacgtccttttatattggcattttacaatccaataaagcaaattaggaggaatacagatgaccttgcagcaattgaaatatgcggcagccatagcggcagcgggaaccatcagcgaggcggcgcaggctttgtccattgcccagcccagcctcaccaatgccatgaagaagctggaaacagaattgggaatccgtatttttatgcgtaccaataaaggcgttgcgctttctcgggaaggagaggagtttttggcctatgccagccgggtgacagaacaggcgaccctgctggaagaaaaatataaaggcagaaagattggaaaacaaagcttttgtgtatccgcacagcatgactctttcgcgatgaatgcttttgcggatttgatcaggctgtttggaaacgaggcatatgatttttatttgcgggagaatcaaaccgacgagatcatagaagacgtggtaaaactgcgcagtgaaataggagtgctttgcctgaacgaatatcaaaaaaaccgcattcaaaggatattaaaggatcgggaattgatgtttgaatgtttatttgttgcaagtccatatgtatgtgtcagctcaacaaatccgcttgcagagaaacatgctgtgaagccggaggatttggaaccatatccctgtctctcctttgaacgcaagacacgcgaagccgtttgtttgacggaggagatcttaaatacattgaaacgcaaaaagaacatttgggtaggagatcgggccaccttgttcaatttattgattgacttgaatggctatacgatttgtcatgggatcattggagaagggtataatgaaaaagacattgtagcaattccactgcttatagaggatgcggtggaggtcggttatatcgtcaatcaaaaaatttctcgcggcagcctttgctcccattatattgaagccttgaaaaatcatgcgcagcaagcgcgcctgtctccgtttcataaaatgcctctttactattcagcataaggagtcatgcgtgtaatctatatcagagcatatttcgggacacctctgatttgctgtagggaagtctatttcttgacttgcactgataaagtggatataattaaaaaatcagcaattatattcgatcaggatgtccgggccacagacgaccggacaacaaatttttacagatcgctgaacaatcttaaaaatatatgaagcttcagatgaggaaacgagtgggaatctcgtacggtcacgccactgtgtagcggttataccgcaaagtcaggtcgtcatctggagtcatatccatcgtttgagcttcgagggaaagggagatggatgcgggagcctatggaattgttccggacaggcggaatataataggcttttgggtattggcccctttccgatggaggaaaggggcttttttagctgttttattgaggcgggcggtctgtttggaaagggggctatccccctttttcaagaatggctggggcgcacaataaagaaaaatataaaaaacaaaggatgaggtggaagcaatgaagaaaaagaaaaccagccggattattgccgtttgtatggccaccatgctgctgattggcagtgttggatgcagcagtgcggaagaaggagcgcgggcgtctgtgccgggcggatcggagcaggcaagcagtctgtccacagatggcgcacagaacgaaaaacctaccgatcagaatgatcagattgttatagctggctaccgcgatccaggccgcggcacaaaggatccctattatacaaacgtaaatctttatgtgtgggagccgttgattggagaaaccgaccagggggagcctgaaccgcgtctcgcgaccagttgggaccgcaatgaggacgccactgtgtggaccttccatttgcgggagggtgtccaattttcggatggcgtgccgtttaacgcggacgctgttttgaaaaattttgaacggtaccgcaacatgggggtggtgtcctccacatttttcgcctttgacgtggacgctgtatatcccggcctccagtcggtggaaaaggaggatgattatacggtccggctgacctttgagaacccgatcccgacgctgccctatacaatgattaatttcggctgtgggatgttcagcccggaatgctacgacccgcagacgggtgaatttaaggaatactgcgtcggtaccggaccgtttgtgatttccgagcatgtaccggacgaatatatcacattggagcgcaacgaaaaatactatggggatcccgccaaagcagcaagcatcaaaatccgcattattccggatcatgaagcgagaatcgccgccttgcgttccggcgagatcatgggcgtctatgacaacaacgcaattttgccccaatcggccaaagagcttggggaagccggcgggtttgtggtttcctccgcgctttccgcaaatatccagtatctcaatgtgaacaatcagaatttcccctttaacgatgtgcggatgcgccgggccatgagtatgatcatcgaccgcgatacgctgctcaatgatatctactgtggctatgggaaaacaaccgtcaatgtcctcagccccatgtccgtgttttatcaggatatccagccggaatataacccggaagcggccaaggccctggcggccgaagtgctgcaggggcagacgcttacggtccggctgctcaccgcgtcgacgtataaaacagatgcggagctgatcagttattggcttggggagctggggctgaacgtacagattcaggtattggacagcgccgccgtctccgccgctttgaaggagcgggattttgatctgtccatgggctttaaggggatgaacaacgccgaacctgaaaccatgctgcgcggctttttgcatacggacgggtttatgaacaatggctttgccatgagcgggtatcacaatgaagaagtggacgctctgctggatcaattgaaggacacgtatgatgaggaggaacgggcggcgctctttaaccagctccagaagatcggagcggaggagctgcctgtgatccccctgatcgccgttaccacactggtggttcacagcgaccaggtcacgggctatgatgccaaatttaccgggattacacttcccgaagtcgcctgggtcagttgaaatgctccgctatattgtccggcgtctgttctccgccgtgccggttctgtttggcatcacccttttggcctttcttctgggaattttaagtccgggaaatccggcggaaatcctgttgagcagcggcggtgaatccgcctatactgcggagcagttggcggaggtggaacgtcagcttgggctggaccggccctatccccaacagtatgtgcgatggataggcggcgtgcttcagggggactggggtgattcgtttcgaacgaaggagcctgtgcgtgaggagctgttcagccggtttggcgtcacgataaagctggcggccggcgcgctgcttttgactgtgatggtgggaattccatttggcgttttaagcgccgcccgcgaagggggactgatggacaggctcagccagtggggcagcatcctgctgctgtcagttccaagcttttgggcggcaatcctgttggttggcatttttgccgagcagcttcattggctgccaacaagcggccaggagacgtggctgcatcttgtgctgcctgcaatcgtgttgtctttttccacggttggcaccacgatccgcctgacgcgctccacagtgattcgggaattgagcagccagtatatcacagcggcgcggggaaagggcatttcccaacggctgatactcggccgccacgccttatccaatgcgattcctccggtgctgacgcttttgggaaattatctgggcggtattctgggcggttcggttgtggtggaatcggtgtttgccatcaatggaattggaaaatttgccctggattcaatcgctgtccgcgactatccggcccttcagggctatgtgatgatcaccggttttacatttgtagccatccatctgctgacagacctgttaagcatttggtttaatccgcagatccgcttggggggaggcgcggcggcatgaagcgaaaaagtaaaatcgatccattggcggccctcgcgctttgcctgctgggccttctgttagcggggagcctgttggcgcctgttctggcgccttatccccctacacagatcaatatggcggagcggcttcagggaatatccgccgcccatccgctcggcacagataccctggggcgagacctgttgtcccgcgtgctgtacggcggccgcgtatcggtgctgactgcggcagcagccaccgcgctttccatgctgctggggctggccgtcggattgatcgccggttatctgggcggatgggcggacggcgtcatcacctggtttacgagcatcttccagggcctgccctccaccagcgtgatgatcgcccttgccgcgattttggacccgggcgtgtccagcctgctgctggcgcttgttctgacatcgtgggcaagcttttcacgggtggtgcgcagcagcgtgctgcgtctgcgggaggaagcatatgtggagggggcgcggtgcctgggagcgggacggctgcggatcatcacccgctatctgctgccgaatctgctgccggagatcgcggtactgtttacaacccgcgtgggaggtgttgtcctttcggtcgcctccctcagttttctgggactgggtatccaaccgccgacccctgactggggggtgatgatcagcgaggcccggaccagctttcggacggctcccatgctgattctggcgccgggcgcgtgcctgatcatcctttcattcggcatcaattacttaggggaaatgctgcgtgcacattttgatattcggggccgtacccggcagatcgattaggaggggcatatgggatcggatattctgatcaaccgtctcacagttgcttttggagcgggcagtgatgcagcggcggtcaaaaatgttacaacgcggtttttctccggacaggtgacgggcctgattggggaaagtgggagcggtaaatcggtattgggcatgtccattttaaggctgctgccctccagcgcccgtctcagcggcgcaatcgaatttgacggggaaaatttgctgtccctttccgcgcgggagatgcaggccctgcggggaagccggatcgggctgatcccgcagagtccgggggattcgctggataaagtgctgcgtatccgcgtccagttggaggaggctttgctggcgcacagtggacaaggccgtaaagaggcgcgccgccgggcggtggagttgctgaaggcttttcactttgaagatgtcaaccgggtgatgcaaagctatccctttcagctcagcggcggtatgcagcagcgcgtcgtctcggcgatggggctttcctgcggcccggaatggctcatcgccgacgaacctacaaaagggcttgacgcggtgctgcgtgagcaggtgtacagcctgcttgacgatattgcgcaaaatcatatcaaaagcatgattattattacgcacgacttgtccctggccgcgcgtgtctgtcacagactgctggtgatgtatcagggacgcgttgtggaggaggggccggcgggggaagtgctggcatccccgcttcatccatataccgcgggtctgctggcggcaatgccgtccagaggaatgaaccccctgccgccgccggacccgtcggttcccgccacaggctgtccctttgccgcgcgttgcacacagcggctggaccgctgtaccggcactgtgccgcctatgcgggcgcagagcgggcggaaagcgaggtgctatctccatgctgacggttgaacatctcggaaaaacctttgtgtccggctttggacgcagggtaaaagcggtgcgggatgtttcgtttcatatcaaagcggggacaacctttgggctgatgggaaacagcgggtgcgggaaaacaaccctgtccaggatgatcctgcgcctgcttgacagcgattgcggccgcatcctgtttgacgggcaggatatcacacatctgcggggagcggcgctcaaagccctgcgctgtcaagtgcagcttgtatttcagcacccggaatcatcgctcaacccgcagatgaccctgcgcgagaatcttttggagcctttgcggatccatcgcctgtatgataagaaccagcgtgaacgacggatccgggaacggctcgagtgggtcggtctttccgaaacgctgctcaaccgctatccgcatgagatcagcggaggcgaagcccaacgggcggtcatcgcacgggctttggggttggatgtgcgcttttttatcctggatgaacccacatcgatgctggatgtttccgtacaggcacagattatgcgcctgttttccagtttgcagcggcggctgggtcttacatatcttttgatctcccacgatttggaggttgtgcgttggctcagccaggaaatcgccttcatgcatgagggggctattgtagagcagggaccgacagaacaggtattggcaaaaccctctcaggaattcacaagaaccttgatccgaagttttcaagccatgtaacgtcggccttaagtataatcccccggctaaaaagccgggggattatacttgtctgccctgtggtggaatttattcctgttcaagcagcttcagtacctgctgaacattttttcttccaaatgatatcgttttttcattcagcaccaagcaggggacactcatcacctgatatttctcccgcaggtcaggaaagtggttcaaatcataaacctcagcggtgatgacatcgttttcggccgcgatccgctgagatgcggtgacaagttccgggcacatggtacaggagagggatacgagtacctgcagggccattggccggcggatagttcggatttgtgcagccgtgtcggggtctaagggctggccgggacctgccgcgttataaagtcccaggataaagcaggtgaattcatgaccgcctggaacgccgtggaaagcaaggcccgtccagctcccatccggccggaaaatccggacgcagggcagatgggcaacctcgctgtcctccgctgtttccacggtcagcatctctgtcagagcgcacaattgttccatatactgccgcagctccccggagagcggcgtaccgtccagatagagccgcagaacaagcggcgaggccatccggccaaacacagttttaagctgggccagcatatcggcggaaaatatgccgccttgtatttctgccggcgcatcggccggcgcggcgtcactggacggtgtggaaaactccggccgcagcccggtcctgcgctgcgccgcggctgcccatcgctcaagctctgtggcggctaatgctccatcgcccacggcggtgaccacctggcgcagaggcttgacgcacacatcgcccgcagcgtacaggcctggcacggttgtgctctgggatcggtcggtgatcacataaccatgctcgtccagttgggcaagatcgtggatcaattccgtggctggctcataacctgcaaagacgaatataccaaaggtttctccctgtggaggtctgtattcggtagtctttccggtggcggtgttgtggtaacgcaggctgcgcagggcgttgtctccagacgcttcctccaccactgtattggtgagtacggtgaccttctcatggttgcgggcggcgtctgccgtggccttggcacaggagaaatcggcttcccggataaggatagtcacatgacgggcgtacttcgtcaaaaagacgctttcctcagcggcggcaaagccccctccgaccacaaatacatccttaccggtaaaaaattccccatcgcaggtggcgcagtaggcaactccccggccacggaacgcctcctctccccgaaatcccaccatccgggggtgcgccccggtggccagcaggacgccaaagcactgtttctcacctcggctggtttgaacgcgcttgatatttccggccagttccagacctgtgacctcggccaacagaaattcggccccaaaagattgagcttgacggcgcatggtttcggtaagcccggcgccgctggcccgttccacaccgggatagtttacgacctctgaagtgatggtaatctgtccgccaaaatgctctttttcgactacaagtacccgatagcgcgccctagccaggtacaaagcggcggtcaaccctgctggaccgccgccaataacgacaacatcatagagctgctttgtatcaatcatagcatgacctcaacggcacggacaaccggcctcctcagagctgccccaccaagtcaaggctgggcttcagagtttcggctccaggctgccatttagctgggcaaacttcatctccatgggcggctacaaattggctggcctgcacccggcgcaacaattcatcggcattgcggcccacattgccggcaagaacttcataggctacgattttaccttcgggattaacaataaagctgccgcgttccgccacaccgtcagactcgatgtatacctcaaaatctcgcgccaaggtatgggtggggtcggccagcatggggtattggattttgcggatgcgctcggaggcatcgtgccacgctttatgaacatagtgcgtgtcacaggaaaccgcatagatctcacagcccgcagcttggaacgaggcgtacttgttggccagatcctccagctcggtagggcaaacgaaggtaaaatccgcggggtagaagaaaaagacgctccacttaccaagtacatcctcttttgtgacggtacggaatgcgtcgttctgataggcttggaccgaaaaatctgaaatttctttttggatcagggacattatcaagacctccagtataatgatatcggttagctatagctaaccgatatcattatactggagtaacatcgtggttgtcaagtatttcctgaatccgctgcttacaaataatagttttcttttcctgggcgaacgagggggtatggtcgagttgtttcttgcgattttatagttcacagcaattgcaaaagccttgaaatacaaaaaataaccgccctttcctgagaaagtaagcggttatttttgcaatcagggctaaacatttgttggcatcgcctctttgcttttattatacctgtccccggtatatctatcaagccgctgctgcttaagccggcagtttattatgaacggaagctacagggattccttgataaagaggcgtcaataattgggcgggcgtcatgcccgttccgcggctgatacaatcgaggatttccaaatttgtatggacctccgcccgctcgattcttgcaaaggttttgacatcgattccgatttgaagcgccagatcctcctggctgattccattgattgtgcggtattccaaaaggttacacgccaaaataactctggattcatcgtatttcacaattatttcctcctgactcgtaatacaatgatttatggaaataattgtataaattagtcgcgtttttgcacaagagtgttgaaacccttgacaaatacgtttaaatgtgcataaagaattagaaattactggatgcatatgccgccaggagaggggacgaatcctgtttttggaactgggcgtggggatgaatacctcgattatcaacaaatatcccttctggaagatgactgctcaaaattccaaggcggcctatgcctgtcttaactacgggcaggctgtgtgtcctcgtgaaatccatagacagaccatctgtatcaacgaggacattggagatgtattgtcaggactgtacaatcggggacacaacctgcaaagataaaaaggccatcctaaagcggcctcaccgttcccagctgaggattgagaacccacatgatcgcccaaaaggatgcgttcaatggacggagcgaaccaaagcggaggtgctggatatatatacgctctggcagaagcagcgcggttttcctctgtccgataaagcggagtcaggctgatgagagtattcgccggtctgtctttttgttttgccgtttgctctgcatatcttattccagattctttgccaaccattacttgtagaattttgcaggctttcagcggtagaataaaggtatgaaagcatcggaaagaacgattttacacgtcgattgtgacgccttctatgcctcagtggaatgcttgtacaaccctgccctgcgtggaaggccggtggcggtggtgggtgatcctgagctgcgccacggaatcgtactcgccaaaagccaggaggccaagctgtttggtgtccagactggggacgcgctttggcaggcacggcagaagtgcaaagagatcacctttgttcccgcccattttgagaaatatctttctttttcccgtatgaccaaggagatcttttcggaatattccgaccgttgtgaatcctttgggctggatgagagctggattgacctgaccggctgtacagagctgttcggggacggaccggcagtcgcaacccaaatccgtcggcggataaaagaggagctgggaattaccgcctcggtaggggtgagctttaacaaggtctttgccaaattgggcagcgatctaaacaaaccggacggtatgacagtgattgcctatgacgggtttaaagaacaggtatggccgctgcccgtaaagactttgctctatgtgggccgggccaccacaggcaagctcaaatcctatgggatcaccaccatcggggcgctggcccaggccccgattacttttctggagcaccggttcggcaaaatcggccggatgctctggatgttcgcaaatggactggatacctcgccggtgagcaacatcggagcaaaatcactgatcaagagcatcggcaactccactacagccccacgggatctgataactgaccaggagatcaagatcactctgtatgccctctgtgagagcatatcggcccggctgcgggagcattcctttcgctgtaagacggtggcgctcaccatccgggacagcagtttaaccagctttgagcgccagcttgccttaaagcggccaagctgtatcactcaggagctgtttgacgcagcctttagcctctataagcagcatcataaatgtggattgcctgtacgcagcttgggagtgcgggcggcgaatctgatgcttatcgactgtatgcagctctccattttccctgatgtggcgagggcgcagaagcaggagcggcttgaggagacggtagatgatatccggcggcgttttgggcactttgcagtacagcgcggggtaatgcttaccgacccggtccttgccatcaatcccaaggaggatcatatcatccatccaatcgggttccttaactaaaaaggacgcctttgcccatactaacaatgggcggaggtgtttttttgatacggaaggtctatgtagaggtgacagcgcactttgatttggaaggaagcatgacgccgctggagattttctgggaggatggccggcggtttgaaattgatcgggtgctggaccggcggcgcgctgccagtctgaaggccggcggggtggggattcggtacctctgccggatacgtgggagggaaacttacctgttttatgagggacctcgttggtttgtggaggggaaatagccatcccatccaaaaacggcgcaaaggccgctgcttctcaaacgcctgatctctgcgcagtggtcattggcagcacagcggtacaggttttaatagcctgcaaggttatgttgcccaaactgcgtggacaaaagtggtgtgttaagccgggagcaatggaacatgaggtgttccttgcaatttttcttgtatatcttattatcctgtagtataataaacgcgttagttagcaaaaactaactgattcgtaataatacgattattgaagggcctgacacaaatactttgtgtggagaaaggaatatgacattacaacaactcagatattattgtatggcatgcgaatgccgcaatatcaccaaggcggcgaaaagatcttttgtgacccagccagcggtgactgcagctatccgagaattagaaaaggaatacgaagtgcgcctgatggacaaggatggcaagcacatcaggctcaccaaggccggcgaaagcttttataaatatgcatcccagatgttagatcatgcaaaaaagttcgatagccaagtgcaggacttagccaaccattccaaaagcctgcggattgggcttacgaagtcggcaggatcttcggtttatatggaatactttttaaatgaggcggaattttatcgggatttggagcttaagctgacggtggattctacattgaagcttctggaagaactccgggagaaggagctggatatcgcgctgatcataaaccatggcagcgaccctatggatgatctggggtgggtagagcttaaaaagacggggatgctttactgtgtctcaaaaatccatccattagcgcaggtggaacaattcacggtgtccatgattgcaggggagaaaatggtttccacacagcatgaccagcacaagtcggaggccttaaaaaaattgtttttgcagcatggctgtgaggacggtccccaagtggtctggcggttcgaccaattaagcacggcgcttaagatggtggcggcaaatctggcgaccggttatttcccggcggacggaatctgccagtacgaagggatcgtaggacggcctgtggagggggacgctcccattccgatctgcgccgtctgggggagggatggctggaggcgcgaggaggtccaacggtttgtaaatgggatagcaaggttttatagggcggcccggtagcgggccgccctttatagtatttttatctgtgctcctgcatttcgatcgtatggataattttatccagtctcgttttgaacctatctattatttttatttatcgattaaaaatttgtttgattttacaaaatcacaaaaatacggtatagttagcttgagctaacccacaaggaaaatcggaggagtggagcatgaatcgaggaattatagagcacaagaaggggatatctgtggcggctatgacagcctttctggtgattttgtttttcactctgatctgcgtgggacgctaccccataagtcctctgcgggctttcgagattatgggaaaatccctgctcggcaatacagaggggcttgacgcttacgaatcaagtgtcattctaagcatccggcttccccggatcctcatgggactcctggtaggagcggggctttctgtttctggcgtcgtctaccaagcggtttttggaaatccgcttgtaagtcccgatattcttggcgtctcatcaggagccggttttggcgcagcattggcgattctgttttcggcaggtatggcggcaacacagggtatcgctcttttattcggacttctgtctgttacaacggtcttaaatctgtcccgaattaagagacgcagcgagctgttcgttttggtgttatcaggggtcatcgtaaaatccatgtttgacgccatggtttctttcatcaagtacgtagcggatccggaggacaagctgcctgcaattaccatgtggctcatgggaagcctggcaaatgtttcctaccgggacgttgtcctctgcgctgcgatcgtgctgccctgtctgattattgccatggcgctgcggtggaagatgaatcttttatctttggatcaagacgaggccagatctttaggcatcaacgtaaagaagctgcggctggctgccattctgctctcaactttgatgacagcagtcactgtatcggtctgtgggattatcggctggattggactggtgatcccccacattgccagactcctcattggaaatgatcatcgaagcctgattccaaccagtgcgcttatgggttctatttatctgttgctgattgacacagcggcccgagcggccacggctggcgaggtgcctctatccatattaactgcgatggccggcgcgcctttcttcgcagtgattctcagaaaaacatcgggaggccgagcatgatactggaagtaaaaaacggctgtttttcttatgggcacagggaagtattgaaaaacgtctccttcgatctggaagaacggaaaatcatgacggtcttagggcccaacggggtaggaaagaccacgcttttaaagtgcattatgggttttctccgatgggacagcggggaaaccgtgattgccaaaaggaacctaaaggagtattccgataaggagctttggagggagattagctacgtacctcaggcaaaacagggcgtgttctcctatggcgtcttggagatggtcgtcatggggcttgacaaggaaaacagcttcttttatacaccgaaaaaggatcagtttgatcgtgccaacgacatgttaaaggagcttggagtcggtaagcttgcggattggtattgcaacgagctttcaggcggtgagttgcagatggtaatgttggcacgagccatggtttcaaggccgaagcttttgattttagatgagccggagtccaacctggatatgaaaaatcaattgcgggttttggatgccattgagtacaccaacaaggagaagaacaccgcttgcgttatcaacacccactttcccagccatgcgttgcggctttcggataagacgctgcttttggggccgggccataagcaaaaattcggagctacggcggaaataatctctgaggaaaatatcgaggaattttttcaaacacgggcaaagattgtaagctttaccgctgataaaaagaaataccagatgatcgcgccctatcggattgccggcaaaatatagagaaattaaggaggaggcgttatgaaatacgcagttttaggccgttcaggaatgaaggtatctcgaatatctatgggtacccaccatctgaacaatccatcggatgtggacaagcacgtaagaaattttttatatgcttatgaaaagggaatcaacttttttgaaacctccgtcacctatggagacgggtattcggaactgatcctgggggaggctgttaaggagatgaaaaggggaaagcaaccttttttcatcatgtcgaaaactcacgcaggagatcatgagacatttcgaagggatctggaaaattccttaaaacggctggggttggaacaaatcgccgcttttacttgcctttggggcgtgaaaagcggcatggagtggaatggcgcgaaatcctacggggccataagggagatggagaaggccagggaggaaggccttatcagatacatcgccatctccacccatatgaaaaaccaggagcttaaacaggtcatggatgattacccctttgacttcaatgtccaaggctttaacgttgtcaacagcgcctgccgaatggatggggtgaaatccacttgggaaagcggctcggggtgcatcgccatgaatcccttggcgacaggagatatactgaaatatccgcatatcttcaacgctatccgcatccgcgaggctcagagcctagtccaggccgcttacgcttacgtgctttcggtgccatgggtccattctgtgcttgggacctttaattgcgaggcccagatcgacgaggctctggctgctctggatgagacgccctactgcagcgaggagctgcaagaggtcggactccgtttgaaaaagagaatcgagagctgttccttaaaggagcggatcgaagctggaaagctcctgcgccagaggccctatattttaagagaggaggtggcggctctgatgggggtttatcccttgagcgtttaggggtaggcatacagacgcttgacagggtgttttcaagcttggtaattatgatgtcatatatggaggaataagaacatgagaaaaatactcagcctgattttggcagccgttttttccctgaccgcctgttctgaggcggggggaagccaagggtctgctgtggtgcaagagccggcggcaacagcgagcagctctggcgaggcaattgaaagctatacagtcactgatgtgagaggcaaggagattgctttcgacgcagttcctgagcgggtcgctaccgtcggaaaacctttcccctccctttactacgctatcgaaggggcgacagaccacattgtcggatgcaatccgtcttcaattaaggcgtacaatgaaagcgtattgaggtacatgtatccgcaattggaaaacgcggttacggattggtgcaacacggattccaccgtcaacatcgaggagcttttaaagctgcgtcccgatgtggtgttcatctattccaccgatgaccaggaaattgagaagatagaagatgccgggattaaggttgtggcccttcggagtgcagagttagacagtgtaaaggaaaatttgcagatcatagcggcagtttgtcaaaaggaggagagaggtaaacaactgatacagtacatcgaggagcagattgtcgaggtgacatcccgcctgactgatgtggctgaggaggataagccgtcggttatcgaattttatagcgatatgaatgtatccgtcagccagtacgaccattggatgattcccagtggagcaaaaaatccggctgaagggttgaccggcaagatgtcagaggtagatatggagcaaattcttgtgtggaatccagatattatatatatcggaaaccattctgatctgatgccttcggatcttttggaaaacaagcaggagggcagagattggtctattgtcaacgctgtaaagaacaatcaggtttacaaaattccaatcggtgcttatcgttgggatccagccggcgcagaaacaccccttatggtcaagtgggctgcaaagctccaatacccggagatttttgaggatatggatatgaggcaagaggtaaaagatttcttcgattacgtttatcagtatcaattaacagacgaacaggtttcggagattttggacaacagacaacaatgatgaggaacggaagctttttaaggccgcatggaagattttaaaaaacaggaggtgcgttagctgccgggactggaagcatataagcactgggactgcggcctttagggcataaagagggcggcggcccagatctgaaaggagaaataatctaatgaaaacgatcacagtactggagaatgggaaaaaatttgaattcagctttgaggacatgctgaagtatcacggagtcggctatccgggcggtgtggcccatgcttttcaggtgatgcaaagggccttcccgcttttagacgacggaaagcttttagaacgccgaaagattgagcttgtgactgcattccccggcccaggcggacgggatgccttcgagcttgtaacccgttgcgtcaccgatggacgaattcatgtggacaaggatatgcctgaggcagcgggaatccttgaaagtccacatggaagatattatttccgctttacatacaaagagaggcatgtaatcgttactatccgccccggtttcgtacatcaggatttcatcaatatggcgagaagggagaaccgaactgagcaggaagaaaaaatcttggcgcaaatgaagcaggatatggcgaaacggcttttggacgcgaatccggaagatatctatgacgcggtgattgcggagtaagaggagcacaatgctgcacgctatgtaaacatagaccaccgcgcggttaagccatttgccggatggctggtcaaacatttgaaatctataagcccccggtttgttagatcccagcagtctcctttttcgtcaaagtattttatataaaaaggctgttatacaaatttcactgtataacagcctttttttaaattttaaaagaataaggcaaaacgaactctccgccacgtttgtaagcaagtgacatagtgttcgtcggacccttatttgcagagtaagtgttcgaaatcactatgcgcagggcgcaggtactttctttcgaagataaaaatgcctggtgcggtaaacggtcgaaatttcaatttacagaacacagacggaaatttttaaaataaaggagaaacgatcaatcttgacaggcatgttttgacgccagtcggttctggtcaaccctctccatttaaccatcgggaaagttccggtgtgatgggaacctccactttgtcattactctgcaatttcttaataaacaaagtataaccacgccaggaaggcgtagctataaggatatgccggttgtacttgcgtattatccgcggataaaccttccgtatccaggttctgccaggattttgtcatcttccatgaccactctgccccgaacaatggtggagatcaccttgccgtggagggtctgtccccagagggggtccagatggggttttgaataaatgggaaatttctcgtccaccgtccagaccttctccatatcgcagatggtaaagtccgcgtcggtaccgatgtggttgccgcacttctccgcccagcccaaggcccgggcgccgttgatactggtgacttccacaagcttctccaacgtcagtttgccggcgttgacggcgtccagcagcagactgccgtagtagtcctctccttctaccccctgaccggatgcgaacgcctcctcggggttgtagtgttttgccaggtgaggggagtggtcgctgcccagaatgtccaccgtgccgtcatttaccgctgcccaaacatgatcccaatttggggccgcggcatggcccagggcgatggtgctgccgttattccgattatagagggtatcgaaacagcggatactggtaggcaggatttctacgctggccagaatgtccatatccccctggcgtttcagcatccggatcaggtcgatatagccgtcgtgccagcagtggagggcccaccacttgcagccggtcttgcggaagaaataggccagctcccaggctgcgctgctcatctcctcgtcgccgtaaagctgatgcaggacattcatcagcgtctggggttccccgctctctttaatgcgcttcacatttcccagataccagtccatgttcatagggtgtatggaaacatactttccggtcttggccgccgcggccaggcattggtgcagctcatagctgtcgccgcagcggaagttttcctccagaggggcgctgttcttcatctccatgatcttgaagcaggatgcccctgcttccaccaatcgcggcagactcccgctgtggaaagccagggggctggggatgggagcaaaatccaccactgcatggcgctcgccgcagtccaccgcatactggaaatcctcgggggaggcaatgccccgggtcaggttgttgggcatgacgcagacgctggtaacaccgccatgggctgccgccatggtaccagtggtatagtcctccttgtcctccacaccgggttcccggatgtgggtgtggaaatcgatcattcccggaaggacatatttgccgtcggcgtcgatgatccgactggcctttgctccaggacaatgaccgatataggcgatcttctctccaatgaccccgacatcggccttctgaaagtcatttccaatatgcaccattccgttgctgattaacagatcgaaaatcaatgttcttccccctttttcaagccaggccctttttctccgccagctttcgaaaggctgcggccatccggtccatagcggcaaaactgtccttgtcgtcccagaagcagccggcgatgagccgcaggtgaccgttgcccatgtcgccgtagaatttgccatcgttaaggctcaccagagcttcctttgccagataggcggtgatctcgctggaatctcccagttttgaaatatcgatccagacgaagaagccagactccggcatctgcatcgaaacaccggggatgttgttaaagagcttgtaggcgtatttgcggcggttgtcgtacttcttcatataatcttggataaagctgtcgtcccggaaggcgggcatgaccgccagttgggccagcgtactggtggcgccctggatattgacggcggcgccgtagtaggtatccatgatggtatccgtggcataggtccagcccacccggaaaccgctgagtcccattcctttggaaacggagcagacagtcacagtgcgctcccacatccccggaagctggcagatgcagatcatctcatgctccgggaaaacggtatcttcaaaggcctggtcgcagacacagatcaggtcatattctacacagaaggccgctaactcctccaactccttgcgggtgtagacagtgccggtagggttgttggggttggtgagcagcaccatcttggtcttggaagtgactcgcttctcgtactcttcgatacggatgtggtagccgtcctcggggtaggtgggtacccggacagtgactccccctatcagctcgggattgaggaagttgctgggatagctagggtcgtgaaccatcacctcgtcgccaggctcgatccagggcatcatggcgaagatgaggccgttatcggaaccggggttgatgataatgttccggttcgggtcaagctgaaagccgtatttcttcttgatacgggcggcgatgagcttcttcagctccgggttgccgatgggcatagtgtagtgggcggggaacccgttctgcagctctttgattgcggcgtccagtacgggttgggggattgaagggtcgggcataaagggatcagcccaactcatcagcgccacaccggcagacttcatccgctccgccacatcgccgacatccgccttctgggcggtggaaaagagtccgccgtccagcttggcaaaggcgggcttcattttggtcttgatatgttccattttaataaacctcctgctcggcttgctgaagaaccccaggggatgcctggggttctgttgtcaaaggattcattactgaataccgatcatcgcgaagataatggcaataatagcggcaatggtggtgttgagaacagtggtaaccgccagatgcttatagccttccttgtgagtaacattgcaggcgttgagagtcagcacaatcgcgctgttgtgaggcatcgagtcaaaggtcagggaggacacgcagatgacccggaccagagaggcgggacggccgcccatggccagcagggtatccttgaagctgtccagcacaaaccgaacgccgccggtggcggagccggagactgcggcgatagcagccaccgccacaaaggcaaagatataggggttgccgccggagatcttctccagtcctttgagaagcaggttataaccggggacggcggtgacgatgctgctgaagccgatgatggcgcaggtggagactaccgattgggagctcttggccgccttgttcaaggtagcgatcgtgccggaaacaccgcccaagcgcttccagaaaagcaccaggcagacgatggcgcccaggtagagggaagcgtaggctggcacagcgaagacattgagggcaaccagcaccacgccaatgggagcgatcaccagagcgggatggggcagcccggccttgttcagatccacatcaaagctttcgtcgggcagtgggacaaagtgttccccccgttccctggccttcctggcctgccggtggagatagtagccgttggcgatgaaaagaaaggcggaaacggtaataccagtgatgggacctgcggcggcagggatcccaaaagcctcggtagaaagaatgttagcgttggtagtaacgccggggagagactgttgggaaacacaggcgcccagcacgcaggcggggatgagggaacgggggatgtcgccgaccttaaagaaagcgcaggccaggggatagacggtaaaaataatgacaaagacgttaataccgcaaaagaccaggatccatgaaacggtgaacaccgcaaggacaatggccttggtgcctgattttctgatgattgcgttggcgatggactcagtcatcccagtggcctctaagaagcagcccagaagctggccgcccagaaagagcggaaacatggagataatagagttggccacgccgcccagataggtggagtaaccgccgataaggccgacgctgccggtacccgctacgataaaggcggcaatgctggacaggataatcaggttcagattcttcaaggaaccaaccacaatgatccccagagcaacgagaatgccgatgatactgattacttcattcatactgtaaaccctcccaataataccgtttttgcatgcggggaccgggaaaccttgaaaggacgcttcccggcccccgtattatgactgcggcgaaccctgaatcagatctctttgtaaaggttccacttgtcgttgtagctctcgggggcgataacaccctgaacagcgccccgggtccagtcgatagtggcgccgccggccacttcatagccgggcagcatgatgcggaaggcattctcgtttttgccgcctgccctcaggaaggcccggcggccgctcttgaccaccatggcgatgctgcgcatggcggcgatgtctttgtcgggagcaccttccacggcgataaagtcagcgggcttgccggcggccagtacaccggccttgctgccggcgattttggccgcgccggatgtggctgcattcagggcttggacgggggtcatcccgcactccaccagcagctccagttccttcacaacggcgacggtgccgtccactggctgagaggggagtgtctcggtaccaacaccaatggcgacgccagctttgatggcctctgccaccaccgccttatgctcaatcgagaactcctcgggggtgtttaccatgcagggaacatagctgatgcccttctgcgccatgacagtcaggttttccttgccaatacggcggccttccaggatggtgtcagcgccggcgtcgatgcaggtagaaatcgaaggatcaccgctggctaccgtcatcacctttttctccgcgccgtgggcgtgctttatcagatcatggatctccttggtggacatctcctgatgatactcgccgttcaagctgtccaagggcttgccgctgacctggaggacgacgccgtccaaaccgcgcgccacatggatccgcatggcgcggcgaagctcatcactgccgctggccataaccaggccgtatttttcgtggccgcagccgccggtgacggcgtagatgggaccacaggtcaggatgctggggccgaaaaacatggtcttgtcgatggcattcttcaagccgatgtcgatgttgttgggcattcccatggcgcggacagtggtgacggcgcagttcagtgcttccgccgcggcacggtaggacacgaaagtacggtaagcggtaccgatgttgtccacatagtcgtcagcctcgggatggagggtatccagccgggcggcgcagtcgataaggccggggagaacggtgcagccggcaagatcgacggcctcggcatcctcggggatggcgtagccttcggcggcgccgacatactccagcttatctttcagggaggcggccaccttcaccggggtcttgccccgctccggggccacaaattgagtatgggcatggctcacggccaaaaggccattttcgagaatatcaccggagccggtaaagattctggcgtttttgtaaacggtaacagacatttcaactctcctcccttaccacttgatgtaggtgccgccgcccaaatccataccggggacgacgggattgtagcggcgcagtaccatgccggggacttcgctccagaccaggcggcagcccttggacaccagagccaggttgcgcatatcgctgatgttctgatccggtttgccctttaccgcgatgaagtcgccgcattttcctgcttccagagtgccggtaaagccgatggtatcggtaagcctggcggagttgctggtggccgctttgatggcctgcatgggggtgagtcccgctttgaccagcagttccatctcccggacggtggcgttagtgccatcgatggggtcagatggcagcagatcagtgcctacacagatggtgaccccggccttgatggcgttgccgatcgaggcgctgtgggcctcaccggtctcatccagtttgcggacctggaactcagggctgccgtggccaactaagtaatcgtggcagttggtcaccgagagggtagctaccaggaaggaacctcgctccttcatcagacaggcggtgtccatctccatgtggtaggcgtgctctacgctgtcgccgcccaactttacaaattcctggatgggtttatcgccgcccaggtgggccgctacccgcttaccggcggcatgggccacctccaccactgcggcgatctcctcgtcggtcatctgcttatcggccattccctcgtgggcgctggcggcgccgccggtaaggccgattttgacgaactgggcgcccttggcgatctccgcccgggcggcggcacggaactcgtcggcgccgttatacatggtagagatgtagttattccaagcgtggccgccgacagcgatgttcagggcgccgcagggtacaacccgggaggcggtaatcatctcgttctccactgcgtcacggatggcgtagtcaatatcatccgggccgccggcggaacggatggtggtaatgccgcagtttaacgcctcacaggcgcggcgaagcatcaacaggctccggtagggtacgccgggtacatcgaaccgatagggcagatagggcatggtcaaccccaggtgggcatggacattgtagaggccaggggtcagggtgtagccggtcatatccaccacattgtccgctttggttacctcattgggaaagttcgggtagtccgctatgctgccaacaaagagcagctcgtccttgttgccgccctgttgggcttggaggtcggttttgaagattagtatcccgtcctcaatggcggtgtcgtggacgccgtcaacaatgcgtccgtgtatcagataggtctttctcatcacttggctcctttcctgtcctcagtttgttttatcctctcagcagcggttcctgccctgcccggtgttcagggatagccggaacgatgcaggaaccgccgctgcgaataccggctgcaagccgcagaagccctttggtccaaggcccggctcatcaagctgggagagccagccccgaaaaggattgttcaccgcgtaaagaccagcggcaccggggttgccggagtgacagcgatgttccgcgccgggccgtttaacatcctcactaagtaggattcaccaggctgtaaaccatcatgaccagggaactggaaataacagggatggtcgtcaccgcatggcaggcggcgcattctcaaaaagctcgatttttacattgttgttaatatcccacattttctccctctggtatggcatcattccaaaggagcggggctcctggttcattcaaatggctaggtaccctgttgagtaaaatttttcgctgcactttatttcattataataatgttatttatttcagtcaataaaatttattttatttgatgccaaaaattcatcccgattttagaatgtttttcacaaaattcatcaacagtaatgaaaatataagtgaaaataattgcagcgatggatactgtgtaatagccatattatcgaaggacgaccacagaaagggggagaagcacgcacagaaaaaatgaaagctatcagtttgtactgtacaaaagtataaaaaacgtacaaaaaagaaaagccccttgtcgtaggaaaataactacgacaaggggcgaattgtatcgtctctctggaagcaggtgaaagcacctgtgaagtatccggcgatctatgggaaacgggaaaagcacccgatacatggtttgtatcgggcgcttcagcatatcctgtggaggatattacgactgcatcaagcggatggacaagccaaataaaaagaaaaggccgccggacagttgtatctccacggcggccaaggctttcaatgctattctgatcgaagtcctgatatggtaaaacgaagttgcgtactatagtaaaccgtccgttatgggcgcgaagcgtgtttgctattgcgcaaatgcatgtagacagtgttttttgaaatgcctaaagctgatgcaacctgaataacagcgtttttaaactggaacacccccttggcatttaactgaaagacaatttccttgttcttcagtgcaggcgctatcaggggatcggcctctacgctttgttttacctgtagaacggtgtcaacgatctcatgctgcaatacagtttcattttgaggaggggagagcgtcgtcagcacctccggattttcaaaataatgtgcaagtacatcctcctgtgacatctgttgataggagttaatacacaggatgccaacaatacggtcattctcaccgcgaattgcaatcgcggtgaaccgaagcgtctccccttttttgttgttggttacatagctaacatagccgcaatcattttcctcctgaaaatgattaaggatcgaccgggccatgttgctgataggcgcgttgacatcgcggcctgtatattggccattgatgatctttaccaccgaccgctccatgtcttccaggctgtacagaacaaattcataattattccctaaataggcggccaaaccatccagtaaagtgacataggattgtatgaccactctatctaccaatgtaaaatccacatttttcaactctttatgatgttaattgaagcaaagcggcatggacgacactcttgacagtgcccaaagcggaaacgggccgcccgggtatcgccctgaccataagattggtataataaccgtgctgcgattattataccatgtccgcgaagcggcatggtataatcggccattggggcggcagcgggccgcgcccgcgaatcgccttggccataagattggtataataaccgctctgcggttattataccatgtccgcgaagcggcatggtataattgcccatcagaaggcggttgccgcgtaagcggcgagccgttgggcatagctcggtataataactgctttgcggttattataccataaagatccgcaatttcaaatgttttcagagtattcaacactaaacagcagagcacataaacaagatacaagtacataaagggctgatgcccggaaaatttttgtacgatattgggcttgtcaactggggcgaattgcgccaatatacacctatggacacgattcgttactaactgaaaacgctggaccggttgacgcggttggttccagacgcttcaagatgggacatttgcctcggatcttcatcatcggattttttttgactggctccgctattccaatgccgctgtgtcggtgtgcagacaggtcccacccttgctgtggtagataaagctggccttggggtaaaaacagccccggcaccggtaaggaattgatacgtgctttcgcctaatctgtgattacccagcggggattggcactttcggaaaatcgtacaaaacagacaggggccggcgtatatccctccgctttggcaaggctttggaaggtatctcagttgagagacatccctaccacattggcatcggcgctgatggtaacatctccccaaaatccagaaatggtatagggatattttctggaaggtgcgtgcagggtaatttcatcgcctacattcacatggagcagttcctttgaccggttggagagaaaaatttctcctttctctgtgggataattgccctcggtcaaatcgtcatagatcttagtcaggatctggtcatcagctccgacaatgacacaggtttttccctgaatggatagtcttgggataaatcatagtttaagccgtcgtatcgctgtgcagcgaccacatccggtcgctgggcaatttcctccacctactggtcggagggcttctccaacatcacatgccaattttcgtgactttaaatgacttgtattttttccatgcggatggccatatccgccatactgaaaatggttgtgaccagcagcacggagatgatgatgcacagcaatgtcatccgattctgccgtttctgcaccttagcggagatggggatcaggctgagattgtgttttactcccagcatctcccaaaatcggtgagcaccccgtcggacacctgcaaaatacggtcggcagcctgagcagtgcttttttgctgtgggtgatcatgagaacagtctgctcgttcttccaggaggcctctttgagcagcgcaataacctcgctgctgttcttcgtatccagatttccggtgggttcatcagccaggatcagggaaaggcgcgtgatcagggcgtggctgatggccacatgctgttacgcttggtatgtgaaatggcgttctatgcactccatgatttctgaaagagtttccggcgcattctgcaggactatcatcctggaatcccattgtagttctcctcccgatcccagagctgcctcaaaatttgttccggagaaagaacaatgttggggttctctatgaagaaacagagcggcttatattctgtggcggttagatcgatacggatgccatctttatatacttcatgcgttaataactgtataaaaagtccgttggagctgtcgtcgccgcccatatcaagtcccatgatcatgtcagtttcttcatcggcagcggtcggtaaaataattggcaccttggatgtccggcggattttttggtacgggtcatacccggaaccgtccggcagggaaacatccagaatcaccaaatcatacggtccctcttgccacaactgattggcttctcaacttgttcggacaactgcgatctcatacccttactttttcattgcaaaggacgggccgctgatcaagcttaaatcatcttctacaaatataatccgtttcatgtatcttcaccacttttaagaatgctttgtgggatcattataaccgcatttgcttcgccgaatttgtgataggctaacaaatctcacaacggacgatctcaccagcaaaaaagtttgccatacccacgtgggcggcggccctgctgggctgcccaaaactgctgatcctggacgagcctaccaatggcctggatccggcgggcattcaggagatgcgggagttgatctgttccctgccagaacggttcagcatgacggtggtagtgtccagccacctgctcagtgaaattgacctgatggccgaccatgtggccatcatccgggagggggaactggtatttcaggataccttagaagctctccatggccgcagccgtcaccatctggccctgcggaccaccaataacgcgttggccagggccattcttcacgagaactccttaccctgccaggaggaggacggatacctcattcttcccattctctccgatgaactggccgctcagtttacccgattgctggccgagcgacatcttggtgtcatccgactggaggagcagcagaagaatctggaggacatcttcttagagctggcaggaaaggtggcgagcctgtgaaaatgctgaaactggaattttataaatgccgccggcggaagatcgttctgatgtgcgccgccgtactggcggtagaactcatctggatggaggcgttctttacccggcaggataccgaggatctgaaatggagttggatactcctgctctacaatctggccatggtggataccatcatccttcccatcggtgtggctaccctggccagccgaaactgcgaattggaacacaagggaaatacttggaaatttatggagaatatgacaaggccaaagcaactctatgctgcaaagctggcctggggggccttggtgctggccgccttgctgatcatccgctcgggaatctttcttgctgtcggaatcgtgcagggctttcagggggacatcccttggggacggtttgggctgtttaccctgatctcctgggcagtgtccatgatggtttacgcccttcagcaagggctgtccctgcgtttcttaaaccaggccgcgccttggtgtgcggcatcgccggaagtttcttgggcatcctctccatgctctttcctccagcgttaacccggtgcgtgccctgggggtactacggccttctgaccctggtaggcatggactggaacccggccacccgggtaacggcgttccattggcagtggccggaacccgcggatctcattctgctgcttctttgggcggcagtatttcttattgtaggccgtacgctgttcgtgcgaaaggaggtatgagcaatgttcctgcgttgtttgcgggcggaactgcaaaagtgccgccgctccccggtatggctggcctttgtgttgctgcctgtctttcccgccattctgggcacaggaaattatcttgggaacatcgaagtgcttgacgatgcttggtacagcctttggagccagcacaccctgttttcctccatattctttcttcctgccttgttgggtgtgttctgcgcctggcaatggcggttggagcacacggctcacaactggaacagttttctcacagctccggtgccggcggcggatctgtacgccgccaagttagttctggccgccgggatttccctgctggctcaggtgtgtatcggtgtgttgttcctgatcagcggaaaaatcgtgggcatctccagcccgctaccgccggaactgcccgactggatcctctgcgggactctgggggcatttcggtctgcgcggtacaactttttttcagtctggtgatccgggcctttgcgccgccggtagcgtttggtctggcggggggggggctgggattgatgtttgccgcccaggggtggggatatgcgtttccatactccctgctgtgtatgggaatgcgggccaacaacccgctgatggaactgaactttgtgccttttctgacctcagccgcgatttatacagcggtgttcacccttctgtccgtctggtatctctggcggcacgatgtggcgacagaataaagtgataatttatgcaaatcattctatccaagcgaacactccatagaggaccgggttgtgccattcacaagctggtcctctatattttgttaaatgacttggcgcattttagcttgcgacaagtgggaaattgtggcttatctctaaaaattatggtataatgtcaaaaattgatgtgatttgtcggaggtggactctatgacgccagaacaaaaagcccgcgaggcaatcgaccagcggttggcccaagccgggtggatcttgcaggatatgcaccagctcaatccaatggcaggcccaggtgtggcggtgctggaatttcccaccagcaccgggccggtggactatgctctttttgtggatggcaccccggtcggcgttgtagaggccaagccggatgaaaagggcgagaacatcaccgtcgtggaaagccagtccagccgatatgccgagagcaccttcaagtgggttaaggcgggataccgcattcggtttgcctatgaggcaactggaaagctgactcgcttcaccgattataacgacctaaagtaccgctcccgccgcatcttcagttttcatcgtcccgagagccttcgcaccctgctgaaatctgaggataccatccgcaataatatgaagcacttcccgcctttcgacaccacgggtttccgcagctgtcagatcacagctatcgagagcctggagcagtcgtttgctcaaaatcgtcccagagctttgatccagatggccaccggcgcgggcaagaccttcacggccatcacggcggtataccggctgctgaaatatgcaaagatcaaccgggttctctttctggtagacaccaagggtctgggagaacaggcggagcgggaatttttggcctaccgccccaacgacgacaaccgatccttctctgaaatatatggagtgcggcggctgaaaagttcttacatcccccaggatgtgcaggtgtgcatcagtaccattcaacggatgtactccattctgaagggggaggaactggacgagtcggcagaggagacttctcccaacgagttgacttcgacagaccgccaagcagccaaagaggtggtctacaacgagaagtacccgccggagttttttgactgtatcattatcgacgagtgccaccgttccatctataatgtctggcagcagatactggattactttgacgccttcctcatcggcctcaccgcaacgccggacaaacgcacctttgcttttttcaatgaaaatgtagtcagcgaatattcccgggagcaggccattatcgacggcgtcaatgtgggtgaggatatcttcctcattgagactcaggtgaccaaaagcggcgcccatatcatgaagcaggtcatcgagtgccgcaaccgcctttcgcgggaaaaacgatggaagcagctggatgaggatgtggactaccagcccacccagttggaccgggacatcgtcaatcccagccaaatccgcatggtgatccgtaccttccgggacaacctgtttactgcgctgttcccacggcgtaaggaagttcccaagactctgattttcgccaaaacggacagccacgctgacgacatcatccagattgtccgcgaggagttcggtgagggaaacgagttctgccaaaagattacctactccgccgaaaatccggagagcgtgctcagcgacttccgcaatggctacaatccccgtattgcggtaacagtggatatgatcgccaccggcacagatgtcaagcccatcgagtgcctgatcttcatgcgggatgtgcgcagcaagaactattttgagcagatgaaaggccggggtacccgtatcctcagccaggacgatctgcaaaaggtgaccccttcggccaccgagaataaggaccactttgtcattgtggacgcggtgggcgtcaccaagtccaagaaatctgagacccgtaccctggagcgcaagccctctgtctctctgaaagagctgatgatgatggcggccctaggcgcccaggacgaggacaccctgacatcccttgccaaccggttgattcgacttaacagccagatgagttgcggcgagcggaaggagtttgcacaggtggtgggcgttccggcctatcagctggcggagaatttgctcaatgcttttgacgaggatgttctcaccacccgggcccgggagcagttccacacccaggagcctacggaggcgcagttgcagacggttcagcggaaggcggcggcccaggcggccgcgcccttctgccgcccagaggtgcgggactttatcgagaatgtccgccgcagccacgagcagatcatcgacaataccaatccggacagcctgctctttgttgggtttgacgctcagaaggaggaaactgccgaccgggtgatccggaccttccatgagtttatcaaggagaacaaggacgagatcattgtcctgcgcatcctgtacagccagacctatcaggaccggcccatggctattgaacagcttaaaaacctctatgagaagctgcgaagcaagggcgtgaccatcgagcggctgtgggactgctatgccatcaagaagccggagaaggtcaaggcaacgggcacattgcgccagttggctgatctggtatccatcatccgttttgagatgggcgaagcgaagggtttacagcccttcgccgataaggtaaactacaacttccagcagtggaccttccgccgcaacgccggcgcggtgcatttcaccccggaacagatggagtggctccagctggtgaaggatcatatcgccacatctctgagtgtccagccggaggatttggatctgagcccctttgaccgcaagggcggtcttgggcggttctatgaggtgttcggggaggagtatgaggcgattttgatggaaatgaatcgggagttggtggcgtaaggagagggtacatagatgtcaacaaaaaattcccatgcaggaacagaaatgagcaccttaggaaatgtggccacatatatcaatggacgagcattcaagccaagtgagtgggaggacagtggattaccaattatccgtattcagaatcttacaaatttttctgccccctataactattcaagtagagagctggaagaaaagtataaagtcacaagaggcgatttgttgtttgcatggtcggcttcccttggtgctcacatctggaagggaaatgacgcatggctaaatcaacatatttttcgagtagttccttctgaacagattgaaaaaaagtatttatactatttcttgcttcaagtagttgctgaactacatgcaaagactcacgggtccggcatggtgcatattacaaaagggccatttatgaatacaccaattcctgtcccatcgcttcctgaacaaaagcgcattgtctccaaaattgaggagctgttttccaagttagacgccagcgtggcagaactgcaaaccgcaaaggaaaagctgaaggtttaccgccaggcggtgctgaaagaggcgtttgaccctgttagcaaggagaagatccttttagaagatataattgaaaaaccgaggtatggaacatcaaaaaagtgtagttatgcttataaaaacggttttaaagcggtgtataggattcctaatatttgctatcagaatggaagcatagaccacaaagacattaaatatgctggcttttctgatgatgaattaaaaaatctggatttaattgaaaatgatttgttgataatccggtccaacggaagtgtttcgctggttggcagatcgtccattgtaaaagcggaagactgtgacgcaacttttgctggatatctcattcgactaagattaaaaaagccgagcgaggttttatcaaaatttttgcactattttttggaatctcatgcggcgagaacatatatagaacatgtagctaaatccacaagtggtgtaaataatattaattctaatgagattagtaatcttcctgtacctaagtgcgatgacttcgacatgcaagcacaaaccgtggtgaaaattgaaactaatctatctatttgtgatgatatccagcaaactattgatacctccctgcagcaggcggaagccctgcggcagagtattttgaaacaggcatttgagggggaactataaatgacagacagaacagaaagggaacttgaaaggcgtgtaattgaagaaataaaaagaattggctatccctcggaaacgattgtcccggaatggaaaaataaaaataaccgcatcgataaagaaagatgaggaaaagtaatgtctgaacaaaccacaaccatcatctccaaggtctgggggatgtgcgggccgctgcgggatgacggcgtgtcctacggcgactacctggagcagctcacctacctgatctttttgaaaatgtccgacgagtacgcaaagcctccttacaagcgagagactggtattccgaccggctgtaactgggcagacatgagcgaccttaagggtgtagagttggaggagaagtataaatccatcctgaaaaccctgggcgagcagggcggcaccttgggcaagattttcaagggtgccaccaacaagatcaacaacgccgccattctgtaccgcatcgtccagatgattgacaaggaaaaatgggtgtccatgtccaccgatgtcaagggtgaaatctatgaaggcctgctgcaaaagaacgccgaggacgtgaaaagcggagcgggccagtattttaccccacgacctttgatccaggcaatggtgaagtgtattcgcccagagcccatgaagactgtcgctgacccttgctgcggcagcggcggctttttgctggcggcccagagctatctgaccgacccgcagtattacaacctggacagggaagccaaggagtttttgaaaaaagaagccttccgtggttgggagatcgtgcccgccaccttcaagatgagcctgatgaatctctatctccacaacatcggcgacctctacggccaggtgcccattaccctgggggatgccctgctcaccgatcctggcgaacggtttgactatgtgctcaccaatccgccctttggtaaaaagtccgctctcaccttcacaaacgaggagggagagcaggaaggagaggatctggtctacaaccggcaggacttctggaccaccagctccaacaaacagctcaactttctccagcacatcaacaccctgttgaaagctaccggaaaggcggcggtagtggtgccggataatgtgctctttgagggcggatccggcgagaccatccgaaagaagctgcttgaaacctgtgatctccataccatcctccgcctgcccactggcatcttctacaagcccggcgttaaagccaatgtcatcttttttgacaagcgccctgccggtccggatcggcagaccaaagaggtctggatttacgacctgcggaccaatatgcacttcaccctcaagcagcatcccatgacctttggggatttggaggacttcattcagcgctataacccggaaaaccggcatgagcgccatgagacatggagcgaaaagaatccggagggccgctggcgccgcttcacggcggagaaaatccttgcccgggacaaaaccagcctggatattttctggatcaaggacaagtccctggccgacttggacaacctgcccgccccggaggaactggcccgggatatcatggagaatctgcaatcggctatggatggattcagtgagctgctggcgacactgaagaaataggaggaagacggtgtgaaagctcggaagaatggctggtacggtacatgaaaggtacctccaagcacttcatcattccggcataccagcgcaattatgattggaagacggagcagtgcaagcagctctatgacgatttggtgcgtgtgatccagtagggaaggaggaatcactttttcggcagtatcgtttcggtgagcgatccggacggaaagatgctggatttcctcatcatcgacggacagcagcggctgaccactgtctctttgttgctcttggccatgtataacctgatgcaggaaggtttggttgtcccagaaataccaaacctcagccagcgtatttacgaagaatacctggtggacaagtggcagacggagaagcgtatcaactcaagcccaacaagaaggacccggaggcctttgagcgcctgttttccgcgagtgcggatgagatctttgaagctatttccaggctggaaatcatcaatatttccctcaactacggagataatccgcagttgatctttgagggccttaactccactggcctggacctcagcgagggcgataaaaaagcgacaataaaatctatacggcagaaagaggagatcatcacttacctgacgaaccatgtttcagcaaagaattccgatattgcagaacttctcggtgtcaaaagcacacgggctaagaagcccctctctgaactgattgcggatgagatcgttgcggctgagggcggcaatcgtaataggacatatcgtttaaagagttgaacctcatatctattccatattggactaaacttaaaggctggagagaaacatggctattagtaaaaagattgagataatctatcacaacggtcagcctgatggcattcgctctatttgtcgtttttatccactatgacgacctatgtcattcctcaccctctgctcgcagaggccaagaagttgaccggaattaatcgccctggtatctactaccttatcagcgagaacgacaataacaggatcgcgcaaatctacgtcggctagtcctgcaacggtgtgagccgtttagatgaccacaatcgttttaaagacttctgaaataaagcaattatgttcctggctgacaacaagactttttctttggatatgatcagtgggcttgaaacttatgcaatcaccaaggcaactgaattcaaacggtacaaggtggagaatagtatcaatcccaggtatgaaatcgttgaatacgatttgccactgattaaagaagtatatagggaaatcaagtttatcatagctacccaggggtataagatggacgacactcaagcaatgctcaatgaagcaaatattttgtatactaccagaaatggtgtgcgagcatttggtgtgtttaatggagagaactttgaagtgctggaaggcttttaggtcgatctgagtcgaaagtgtcactcgcacaaaatggaactgcaacgacaaacagcagcccggaacggcgatatttctatttcaggaaataaacataaactgaccgtttctatttcctttacttcgcccagttctgctgctatgtttgttcttggcggcagtacaaacggttggattgaatggagggatccagacggcaaaactttggatgaactgttccgaaaatcgtaaagccaatccataatacgaaagagcatctttaaggcatcaattacggctatcaacttctaataatactgaaataccagaagaatccttaaagttaggaggacatacaagaaatccagctttgatttcttggcagatgctggcccgcactggcgcaaatcggtgcggcagcagaaagttatgtctattccgatgccaatgcctgtctgtataagcgggtgtgtttggtgagcggttaattctggagatttttgcttttgagcatatacaggaaccgacctccgataacactcactccaatcggattcgcttgttaaaaacgggaagtcctgattcccaagaaaatcgacgatatcctatatgcgcttcgtaagacccgaaatgacgctgtccatgtggatgccgcttccatggaggacgccaaagccttcctctctatgacctataaccttacggtttggttcatggaggtatatggcgattggggatttattgcccctgcttttgtcatgtccgaaaatgtggcacagcctgaccatgaggccatcatcaaagcacgggaagaaaagattgctgcgttttccaagcaggttgaagcagtctctactacggcatctgccaagaattccaaagaacgggcggagaagggcaaaactgtatccgaaagcatggagctttccgagactgaaacccgttacataattgacgaacagctccgcgaatatggtgggaagccgatactaacaatttgcgctattccaaagggatccggccacagaagggcagaaaccttgtcattgcggaatggccatcagtgcaaggagtatgtcaagggaatcaaggctgaacacaaggagcatatcatcagccagtggggagtatataaggttccttcgtttttgctatccctatgcaaaaacaatactgccgtgaatttgcagagagccagggatggaccatcatttacaagatccgctatccctaggactgtgacggtcagaccggatatttaggtgagaaactggacggcattgttgataagatcgttatgcaactctttgagcggatgacgactgcacccaggagccagctcattcaaaaacagcgtgagaaggaacttcaactggcaaacagttcggtggccaatctggagaagctccatgccgccacggagtgagagctggagagctacaagaaagaaatcatcaagaccatcaacgggactggtagtttcggagcggacatcctcggtgagatgatcgaggacacccgaaacaaactgtcggctctggcacaggaattggaacaggccaagggaaaagcggctgatctgaagaactccgctgttgccgtacaaaaagagtatgaccagatcatgtcctgggcagacctgtatgccggaagcagcatcgagggaaaaaagctgatcctgcggcagttgatcgacagggtgaacatcggacgggattttgagatcgaagtggaattcaagatcagcgtcacacagttcttcgacttcctgcatccggaaggggacacgtgtgtgtactatcgcgcatcctgaaagcatgaaaaaactcggaagatctcaaaacgagatcttccgagtgtggtggagacgaagaggatcgaactctcgaccttacggatgcgaaccgtacgctctcccagctgagctacgcccccaattcttctgccatatctgttcaactcagatcgcgaaatttattatatcaccgtattttccatatgtcaatacaaaatttacataatttgatcaatgaagattgtaatattaattgcgaaaggaaaacgcgacaaaaagcgcggcctttcgcaatttttatttagccccggcgcaagattttagatgaagcttagatagaagatgacgcccgcgccgggctgccctgtccttatcaatcaagcgggaggtgtgtcatttgtgggtttatacatatgctcacgcaacaagcgcaaccggttgacggcaggccgcctttatgaaggcagtattgcctattacggccgcacgccgtatctgtactgcacagacgattccgggaaacagcgcatttatcccgaggcttattttgtggaagcaggtgtttcatttgccgggaaagcccaaacgcatacacaatccaaacaacaggaggaatacagccatgtatgagacaagcattttaagcgtacagcagacaactttcaagggcagagacggagaaccagaccggattatgtggaaaatttactgcgccgacagcacaggcgcggtcggctgcatctattccacgaaggaacgcaaagccggtgaaatggcccaactcgaccttgtggtaaaccgtgacggtcgctttaccgcaaagcttttggattagcccgcctttaggggcggcgtccataaccgggttgccgcccccgaagggggcgctacttgataagtgccacaaagtgtcatcacatcagatgattgcattttgtccccggcaatggactatgaagttaaatacaactgcaaagtccgttattttcctgacaaccaaatcaagatcacatgcttttcaagacctgtattcaatccactgaaagccgaactttacggaaccgaaccaaaagaactcgtatccttaaaagaatacgacccggagactggcgaaatggcttacaaatttgtagaaggaaagacaatttactccccgtttgaagaccggtacgtcccgattaccctgtataaagagccgggagaaaagaggacgcgcaccgacagcgtcaagcgggcgatcgataaggcgtttgaaatcgggctggccaatcagttccggtacttcataacactgacgctcgatcaggagaagatcgaccggtatgacacggcgaagatttacccgaggctgcgcgtctggttgagcaacatggtacagcgccacaaaatggattaccttctgttcccggaataccacaagccccgccccggtgaaactgaatgcgcgatacactttcatatgctcgcgaacgcggacaggctgaacctttccgacagcggcagacagacggagaacggacaggcgatctttaaccttccgggctggaagtacggctttagcaccgtcatagagctggacggacggcccgcaatcatcaagtatgtgacgaaatacatcaccaaaggcaatgctaagattttcggcaagttttatctttcaggcggcaagacgctcaaacgggaagtccccgccgaattcatgaatattgattacgcatcgttcgagggacaggaatacacaatccccggtacgggtatgcgggtcaaatacaagacgttcaatttagattgggataaaggggaattgccgcatgaaccgtcataaccgctttacctcgcaatgggtgttcctgctttgcggcactctgcttgttttcattgcgctgtttctggtgctgcctgtcgccatatccgccgaggataccgaaccggaaactatggacgtgcaatccggcgcgggatggatttaccctgaacctgttctggattcaggcggcgcggattccttacagcttacgagccagcagcttgacgatctcgaggcattgcgccgcaattcagatatttttctatacggtatcttccccgttactgtcagcctgattctgctgatatggggcgcggtctggttttaccgcaccttcattgaaagcggtctgtaaatcaaaggaaaggaggaaagcccatgccgacgatgatcgtacttgattcgggcgtcccgccgtccgtactgacaccagaggacatgacgccgattatggacagcgttgtcgccaatatcggggtgctgctcccgattgtacttggccttgcggcggtctttatcgggattaagattgtgccgcgcctgctttctcactttacaaaattctgattgttcccgccatagcggtgacataacaaaaatttaaggaggtttaatcatggacaatctgccgacaattgccattacggaggaaatgctgaagccgctggttgagggcgttgttgccaacgtcggtgttattttgccgatcgggcttggcctgtttgcaatcttcctcggcatccgcattatccccggcctgatttcgcgtttcgtgcacatgtgacagcggcgatgagacagcgaaaaaatcaagggaggtacagccatgcctgaaacaacgttaccatatcctagtattacggaaatgatgcttttaccggttcttgagggtattatcgctaacattaccgtagttatgccgattctgcttggactgttttcaatcttccttggcatccgcattatcccaagtttgatctcccgtctgtttcacacgtaatcagcgccttgcggcggcggcctgacaaggccgccgcccattcttttcaggagggatttaacaatgtgtatctgcttgaccgcttcacaggctgtcttggaacagattgcaaaacaattcggaatattagccgccctgtttttcctgttgggtatcacgttttcggtcggatgcacatccggcgcgaagcttttatattctgttttcctgagcatcaaaaataaaaaaataaggagggaacgcaatgtttaattctccgcttctcatgcaggcggcaaccgcaatcatgctgtcgggagacagccgtatatctccatacattgcaaaccgcaaggaatacgttccatggaatccaatgtttctagaggaaggccgggaagtaatttcatattatatcggcgttgcttttaacgtcggtataacggcgtttttaggtatttctgttgtttatcttctcattaagatacttaacaacttttctagataggcggtgacaatatgaagcgttttctttccatctttacagccgctttcctgcttctcacctgttccatacctgcgtttgccgactggtcggacgacagcgcggacaaggtctttatcccggatgtaccgtcttttgtatccccaaacggcaatacaactgtaaagtttgagactaccaacaaggaaatccagtctgactttatagacaatttaagcgacgcgccatatctggtgcttttacgtcaggagcttacaaacggctactacgagggcgaatacatcggcgacgaccgccgctggtgggtgtatatcatacggtttcctaccaaaaagcccgcgagtacgcttttaggtgaattttcctatcgcaatccgcgcgacgctgacccgatgcaattcatgccgcatgtgcagggggcgaagtacattcttttgcagtacgactttaaaaaggacaagctgatctgcaacaaccagatttacgacgcggcgcagatgcttcatttttcctatgtaatcgatgcgtcgccgctggccggttcgattccgaattatccgtttaagaatacgcttgttgcttctgccgccagttctggaaaattcaacgtactgcccgaaaaatttgaaatacctgtcaacgggaaagacatcaaccggtattatgactggtggctcccaatccgcacggggacaatgccaccggagattacagaccccgaccctgacccggatattgacattgatacagacggtgacgggataccagatgtcaatatagatacagatggcgacggtgaaccggatgtcaatgttgatacagacggcgacggcgaaccggatgtcgatatagacacagacggtgacggggaaccggatgtcgatatagacacagacggtgacgggaaaccggatgtcgacatagacacagacggtgacggcaaacccgatgttgatattgatacagacggcgacggtgaacccgatgtcgacattgatacagacggcgacgggaaacccaatgtcgacattgatacagacggcgacggtaaacccgatgtcgacattgatacagacggcgacgggaaacccgatgtcgacatagacacagacggtgacgggaaacccgatgtcgacatagacaccaacggcgacggcaagccggatatcaatattgatacggatggagacggcaaacccgacatcaacgttgatacaaatggggacgggaaaccggacgacaacatagacacagacggcgacggctggccggatgaaaacgtaaagccgggaggttccggcggcggtcccggtgggggcggcggcgggacctctggcggcggattggacatcccgccgaaggatgacgactgggagtataagggatggcatctatttgacccgttcgattacgactacacaccccccggcagttcgtgggacgattacgacccattggagggttacgaccccttcggctcctctattccgtgggaattcgatatcccggacaacaacgtttatcacaacccttggtgggtgcccgactgggcgaaaaatacaggagtgatgatttatgaaaagatggaaacggttcttagcgagcgtctgcgcagccgtatgcgcggcgggcttttcgcttcccgcctttgcggctgattcctccgcgacatggaacgagggcgttcttaaagcaatgtcttatattgaaggctctgacggcgaataccttttttcgccgccggatgaaatattcgatgacaattctcgttctatctggcaacagataaaggaagattttaacgatgacagccgggttgttcttgtaggcttttattttccatcagttggggataggcttagtattgtttttcaatctcatgataaagcaacattgaagtttgagaaatcttctacttcgtcaaatctttcttactcttacaattcttccgacgggcttttttgccgtttttccaattctccgtcacaggaaggaatttcagttgttcaggcttatgcgttttctaataacaaacaggtgttgactgaaatgttttcttctaatccacgtcagcctatgatgtgggcgaatcaaacggatattgaattactcccatcttccgatgttgcttttgcaagcgatataaagaacattgtttttgaagcgccgcccacaccggcaaaacataccctaaccatccaataccagtatgaggacggctcgcaggctgccgaaccggttgtcaaaacatacgaggccggggcggcatatcaggtggtatcgcctgtcatcggcgggttttataccgatcaggcaattgtatccggtacgatgcctgacaaagacctgacgattactgttacatatctgcctgtaccgggcgagcttttatacacactatcggttgtctatcagttttcagacggtacaccggcttcagatattgtaatcaagcatctggaggctggcacaccgtattcaatcgtttcccctgttattacaggctacacggcagacaagccaacggtttccggtacgatgcctgaaaataatttaaggattgttgtaacgtacaataataattctggttccgagggtggcggaagttctctcgggaaattccccgatgttggcgctcatctggattggcccagcccttttgaatggtttgatgttgctggtcatattgacttccccaatccatttgcctgggggtgattctcatcaatgaggaatacgttgttttctctatggacgcgctcaatgaaatgtcgttcaccatctggacaaacatcggttctatttttaacgtctgcctgtggacatttatgatcgttatgggcgtttatgcagtattgaatattattgaccatgttagccgatagaggggggcgacaacgtgaaaaaatccgcagtttttctggcggtaatccttctgctggcgctctgctccgtcccgtgctttgcggaaatccaatggccgccgcccaattacgacatgccccggactgtgttaagcgaatcgtcctttgattatctttccgaaagccttaaaatctcatacggggcgctttccagtacgggactgcggatagccggtgtggttttctccgtctgcctgatctccggtattttcctgcgtctgttccttgataagctgaacttgtataacagcgtttggaaacgggaatttcaccgcaaagtcaaggccgaggacaggcggcgcaaccttgattccattgttgacgatcgtgttgctgatatggaagtcggtatgcttgcaaaggcgcgtttccggctgcgcaatccgcttgccgatctgaatgaaaaaatctatcagcgcgaattatcctatcaggcagatcaggcaatccgccagcgccatccggaacgcgcttacgaggaagctatatacaggcggcagatttcagcggcggcgggtattgaatttatgcgccgcaatccggttctgtccgctgaaagcagggtcgccaaccgtgaaaacaattgggtttccgaagggattttcagataccgcaatccgaattatgttttgaaacgcaaggtggacgaccggttcctgtcggacgaggctgacaggcagtacagggaacaattccccgaacgatatgaccagcggcgggaaatgtacgaaaacctttcccgtgaatacgacgaagcgcggcacaggcgttcccgccgccgatggaggtaatacggatgcgtaaaaaatgcctgattatcctgttggccatactggtcgcgtttactttgtccgtccctgtccttgctgcggacggccagagccggggattttttgacacgctcgcggatatcggaatgtttatccgcaatctgttcgtaccggacggcgattatttcaacgatcagctttccagcttaaacgaccatgtcaacagccgctttgcggggcttggccagctttaccagatgattaacgactttttcaagatactcgccagcccgcccgacataagccttaggcttacgataccgaataattttctgtttcccggctatcgcggaacaagtgtcgatgtctttgcgtccgggcgagtatatatagattttatccgcaatgttttaaatgcgagcgcctgcttgtttactgcgattacctgctaccataagctgcggcatttcttcaccgaggagggatagcgcgtgatcattgagcttttctttaatatcttctttgcgctggcgcactttttaattaacctgttcccgaaattccccagctttaacggcttaaatatgtccatgtcgccgctgctctatgtggtcaaattcgtcaacatgtttatatccgtttcccttctcagccgctgcgttattattgtactgatcgtctacaacctgaaattcgtctggtctattttgatgtggttaatccgcaagataccgggggtgtcgtaatgatcgatatgggttctgtggttgggaacatgtttgcgccggtcggctctttcctcggtctggttattaaaatcatcgtctgcggcggctgtgcgattctattcggcgcgctggcttatttcttcgtccgttatcatttcaaccctctgcggctgcgtgtggacgatctgcgcgtgccgtacatcaaaaacaaatggtttgacctgttccgctggctgctcgttgatttccttgaacacgacttgcaccggggcgaattcaacgaatacgggttcacgttttatgttggccgtcagggcgcgggaaaaaccatttccatggtgcggtatcttgagcttatgaaagagaaataccccaaatgcatcattgttaccaactttgcctattaccgttccgaccatatcatgacggactggcgggatatgctgacgctgcgcaacggcacggacgggattatctttgcgattgatgaaatccattcggagtattcggccaaaagctggaacgacgtgccggaatcgctgctttccgaggtgtcgcagcagcgcaagcagcgggtgaagatcgtggcgacggcgcagttttttacacgggtcgcaaagcctttgcgtgagcaggctgcgacggtggttagctgctccacatgggcgggacggctgaccagaaaccgcgaatacgatgcgcttcaatatgccatggttattgaaaatccagttgcggtcaagcgcaaggtcaaacccctgcacaaggcaagctttgtacagtccgacgctttacgtgcctgctatgacacgtttgaaaagattcggcgcatggaaaaaatacagttctccccgcgcaaagaccggggggagaattaacgcgagacagccgccccgatcggggcggctgtcgtttccttttatggccggaacgggtacgctctttcattcggcaagctgtcgtaaagctgcacccagtagccgggcattttctcccacatttggcggcgcacatcgaattcggcggtcacttccgattccacgacggagcagggtacgccgttgatctgcttcatgcagacatgcttttcgattcgttccagcttttgcgtcatgtagttgtatcggtattcgcagcgtttggcggggtaaatcttgctgtatacgggttcattcatgctgttcctcccttctgccctcgtaacctccggggcgggcggtgcttacgccagtttgaatgcgttgaacaagaattttccttctccatctcggacaatctcgaccttggtaagatttccgagtgccttgctcatcggagagccataggtaccgcgctcccacaagccagaggcttccgccatcttccagaagcagttgacctcaattccggcattcggacccgggaacgcgtggtgctttgtgaaccgggccttgataaagttctcgcaccactcgactttgatttcttttttcatggttagttatcctttctgccctcgtaacctctggggcgggtaattatcatctttcgaattccactgcaaacagatagccagaaccttttttgtcagtatcgaagtcgaattcaagaatgaaattatatgcgctggcaagaaacatttgtattttgtaaggggctactgaataaatttcacagcggggctcgtcccaatcctcatgtttttctttgctgtaatagggtgtttgacgatcgtttgtccaactgtcataatccgtccaatcggctatatctgcaccctttttctgcatggctttggtgcaggcagtaaaaaatgatcttggggtaatattgcttcgctgcatctctactttatataacgttttcattcgttctgttttcctttcctgttgacaaaattcgatggatttgctattatttgggtggataaagaaaccgcctttttgcaatgggaaaaaggactagctctttattccgctatccgcagataccatgttccagcatggtatctacagaagtagcggttttgcgggtttgccatgatgaaacacagcaggtcgtaaagccgtttgctttgcacattttcaccgcctttcttttttagagggcggtttctttatccgcgcttaccccgttccccaagcttggagttgccccgtcgccgggggtggaggggcttgcccctccttgtttacaaggaggccgcgggcgcggcggacagtcaatagaccgtgggttacaaaatggttacaaatgcgttttagcacgctctgacaggttttcccgatacctgcatttgtaactgttttgtaatccgcgaaagttattgacggtttgccaagcctgtggtacaagcacctgccccattcgatgtaaggatgaggcagggacacaaacggcatgtaaaggcgacggggtgtttgttttgaagggcaaggggactttttgtcatttaggatatgcggacaggattaagattgaggcattacagaaaacggggacatgcgttaaggagattgcggcgtatataggctgttctgtcagtacggtctatcgggaactgaaacgggggagctacaaacggttaacctccgaatgggagacggtatccgcttacagcgcggacattgcacagcaggactatgattacaaggccacggccaagggcgcgcagcttaaaatcggggatgatcatgcgtttgcggcgtacatagaacggaagatcatttccgagcggtattctccggctgctgttttgggagaaatccgggcgcgggggctggcttttcagacgacggtctgcgttaagacgctgtacaactacattgaccggcgtgtattcctgcggctctccaacgaacatctgccgcgccgcaaggattccaggcggccatattgcaaggttcatgtcaggacaaaaaagcccctatgcgaaggtatagaggcccggtcggctgatatccagcgccgtattgaggtcggacattgggaaatggatacggtcacaggcaaggccaagggaaaaggacaggttttgcttgtgctgacggaacgctccacgcggcaggaaatcattatgaagctgcggcataagacaacagccgaggtcgtccatgcgcttaaccgtctggaacgcaggtacgggcggcggttccctttgctatttaagagcatcacggtggacaatggctcggagtttatggactgtacggggatggagaaatcttaccgctcaaaagcccaacggacaaagatttactattgtcatccctattccgcttgggagcgcggttccaatgagaacgcaaacgcgatgattcggcgttttatacccaagggaacgccgatagagaactacagcgaacaggacatccaacgcattcaggattggatgaaccgctacccccgcaagattcttgattacaaatgttctgacgacctttttctcccccacctgagaaccttatgactgtttgaggatgtgtgacggtatgccagatatgccaaggctcaatttagacgaagtaattaacaaagtattctggcctaattttttgaaggttgtccttccatttgtgattgctgggcttatctttgtgattatccgtctactgtttcgcagggcgttatgggacatgccaaagacaaagatgattgtcgattttgttcttgctttgatctttcttctggtgtgtgctgtttttgttgtaccgttggtcaggcatttgattgaaacgactgaaattccggacgatgattacaatatggttgtgaacgctgacgggacaccatatgaatttcacgaccctttcgaatggtttgatatggcatccggtattgagtttcacgacccgttcgacccggaaaattgtccggatattgtgtccggggttgaatctgacgcgcccacacgatcgggtgattatgatgcatctttgacggaataataccattacgtttctatagtctcagaacatcatcaaaaaaggttgaggggcaagctatgcccttcaacctttttcctattttatggagactgcttttgttaagaatgaacaaacttttaaatttccactacttttttcgcaatttcacttgcaattcacctactgtatttgcaaaaataaatatcgaaatccgcggtagccgcatttatttttcggtaaaaataagaacgacgttcgtttattacgaacaaaggaggggctggatgaaattagtgacctttctggcagaaggtaaggagttggttggcgtacgttcagaggatgggcggtattactatcctatctcggctttgggtttaaactatcgggatatgaatgaactggtcgattgtataaccgacaccgaacgcggccgccttgctgcgggtgtggcgaatggctgtgcagaaaagttttccagtggggcggtaaagctttgcgcgccgattccgattccaaagcaggatctgatctgcctgggtgaaaattacatggaccacgcgaaggaatcctttcgttaccagaacacggcctttgatggggagcgcccgcatgcagcctattttggcaagcgtgtaaaccgtgcggtgacagatggagattcgatttgctcacacgcaggatttactgaacgcttggattatgaggcagagcttgccgtggtgattggaaaggatgcggacaatgtatccgaggctgacgccttggattatgtatttggctatatggccgcaaacgatgtaagtgcgcgtgatatccaataccgttatgcacatccgtatttcggcaagagcctcaatggatttgctgtactaggtccctggctggtgactgcggacgagattccgggcattccggccttgaggattcagtcgtgggttaatggcgaagccagacaggatggaaataccagtcagatgatctttcagataccacatattatcagtgagctttcccatgggtttaccctaaaggcaggcagcatcattctgaccggcacgcccgcgggagtcggcatgggatatactccgccgcgctttttacagccgggtgatctggtggaatgctgtgtggaagggcttggaagcttgaaaaaccgggtggaatagcaggcttttataaaggcatagccacacaaacagccttccttgacaaagcgggacagaaatagtatgctttgcctgaatcagtttgcacatgtattggaagggacaggggttcggctatgaaaggtgaaaatgggacagtggtgcagtcagtattgcgcgcgctcgatattctctgctattttcaagacaatgaggagcttggcatctccgaaatttcccggatgatcgggttgggaaaaagcaccgtgtacgcgctggtaaattcgctggtttgccgcaattttctggagcagtcgcctataagcaaaaaatacaggctgggaatccgcaactttgagcttggccggtatacacagcagaggatggatctgcggcgggaagcctcgcccattgtcatggaggtgctgggcaagttccatgagactgtccatttagcggcgcatgaccagggagaagtggtctacatagaatcctaccgtgttccggatgtcaccatcctttatacgcagacaggacgccgcgctcctatgcattgcagcagcgttggaaaagcgatgctggcctttctgccgggttcataccttcagcaatatgtgctcaaccagccgctaaaggcgctgaccaaatacacgatcaccgagccggaagcattgctgcgcgatctgaagcaggtgcgtgagcagggctatgcaaccgacgaccaggagatcgagatggatttgcgctgcatcggcgcccctatttttgatttctcaaaatcggtgatcggggcggtcagcatctgtggtccgatctatcggatgggggatatgcgaatgaaggagattgcgccggagattgtacgttgttcccgattgatttcttaccggatgggatacaaagaagggatacagtaaacatttgtatttacttaaaagaaaacttcggttttcttttaaatttcccaaattttacgaacgatgttcgttaatacaaaacaattttcaagaaaaagggataaataagccaaaacaggagaattgaggaaatcgatccaggctatttagctagccgcaattcgaggaggttttacgatgaaaattttaaaaaccgtacagaaggttcccggtggaacgatggtaatcccgctgctgcttggcgtccttttcaatacggttgcacccggtctgctgcaaattggcggcttgacaaccgccaccttttccagcgcgggggcaaatactgcaatgggaatctttttggtttgtgtgggcagccagattcgtgtaaaacaggctccgcaggtgctcaaacgcggctttgtgcttttggcggcgaagttcctggcgggcgcgtcaatcggatgggcggtcggcgcgttcttcggtgaggcggggattctcggcttgtcctcgctggcgttgatctcggcagttaccaattcaaacggcggattgtttatgtctctggcaagccaattcggcgacgatatcgatattggcgcgcaggccattcttaatattaacgacggaccgtttctcacgcttgttgccctgggtgcatcgggtatggcagatatcccgtttacaaatttgatcgcagcgatcgcgccgattctgattggatgcatccttggaaatcttgataaggatatctctgacttctgcaagccggcgctggcaattctgattccatttttcgcgttctgcctcggcgcgggcatcagcctcagcaatctggtcaaggcgggcttcccaggtattctgctgggcttgatctgtgtcgtatggtcggcatttatctgcatcctggccgataaattcatcctgcgccgtccgggttacgcgggcgctgcgatttcaagcgcagcgggcaactgtgtagcgactccggctatggttgccctggcaaccacccagttttcaccggaggtggtcgaaagtgcgacagcccagtgcgcggcggctgtgattgtcacaattattctggtgccgattgtgaccacgctggctgcgaaaaaatggggtacggctgtcgaatgggaggcgaaaagggcgtcgaaggcgtgacgctcgccataaacagcagactcattgaacaaactggagtacaggaggtagcagatgaaagcgaatgcgattttattgagtacaaaggacaatgtcgtaaccgttgtggatggagcaaagcaaggcgaggagatccggtattttgcaaatggagagcttgaatctctcattgcgcgggagacaattccaccctgtcataaggcggcgatcgcaccgatcgaacccggcggccatgtgctgaaatacggggagagcattggagcggcaacccgcccgatcggtgtgggcgagtgggtttcacatttgaatatcgagagcctgcaaagggattacaacagcgaactggatgaaaaaagggagggttgagcatgacttttatgggatataaacgcccggacggactggttggaatccgcaatcacgtattgattttgccgacctgcgcctgtgcgagtgaaacctgccgggtcgtttcacagcaggtagccggcagcatacatatcatcaataacagcggatgcgcggaggtcaaggcgaatgaggatatgacccagaccatcctgcgcggatttgcggccaatccgaacatctttggcacggtggtgatcggccttggctgcgaaaatgtcggccacagggaactgcgggaggctatcgaaaaaataaccaacaagccaatcgtctcattcggtatccaggaggagggcggcacccccaatacgattcgattggcggttcgtgccgcgcgggaaatggttgcggcggcttccatacagaagcgtgaaccgtgcggtatgtccaatttgatccttggattggagtgcggcggttctgatgcgacctccggctttgcggccaatcccgcgctggggtatgtcagcgacaagctgattgcgatgggggcgtccactgttatggcggagacgatcgagctgatcggcgcggagcatgtgttggcccggcgcggcgcaaccagggagatccatgatcagatcattacaatctgcaaggatttcgaggattaccttcatgcaatgggacaggactgccgccacggacagccgacgccaggcaataaagagggcggactgtccaccctggaggaaaagtcgctcggctgtatcaataagggaggaacatcccccatcgtcgaagttgtagcggaaggccggcgtccaactaaaaaaggtgcgattattatggatacgcctggatatgatatcgcctgtaacaccgcgatgatcgcaggcggctgccagatgatcgcatttacaaccgggcgcggtacgccgaccggccatgcgatcgcgccgattttcaagattacaggcaaccgcgccacctttgaacggatgaaagataacatcgaggtggatgtgagcgcgcttactgcgggcgagatcagtattgagcaagccggcgaaatcatctatcacgagatgatggagattatagaaggtaagctgaccaaggcggaaacttacggcttttcagatactgcgatcgatcgaatttgccgttttatctgatgcggcttacaagcctgtatatcttttgccgctgatctgcggcgcgcagaagcctgataaggcttcatgaaagacatcccatatttgggtggtggaggttaatatgaacgagtggcacacggataaatggtttacaagcaattggaactttgcggaggaggtgcgcagagggattcattttaaagatggaatcaagatacacgatgtaacgctgcgcgatggtgaacagcaggctggcctggtactcacgtgcgatcagaaaatcgcgcttgccgaaaagatggcggagttgggcatacatagaattgaagcgggaatgcctgctgtttcagccgaggatgccagagcggtcagcgagattgtcaagcgcaggctgcctacggagatatttggttttgcgcgctgtatggtcgatgatgtgaagcgtgcggcggactgcggggtatctggtattgtaatcgagattccatcaaacgaggaaatgatccgggaagcatacggctggagcttggaaaaggcggttgagctgtcggtcaaggcgacaaaagcagctcagggagccgggctgtacacggtgtttttcccaattgatatgacacgtgccaatattgactgggtgctcaagctgattgggcaggttgccgcagatggacatatggacgcgcttgcagtcgtggacacgatgggcgggctggctccgcatacggtcccatatctgattgacgccatcaagagccggattgacaagccgctcgaggtgcattttcacgatgattttggccttggtgtggccaacagcatcatggggcttgccgcaggtgcggatgtggtgcatactacgatttccgcctgcggtgagcgtgcaggcaatgcggcatatgagcatttggcgctcgcgcttttgacgatgtacggctatgacctgggacttgattacagcaaaatttacagcctttccaaattgttgcgcagctttatcgatcttccggttcgcggcaatatgggcgtgatcggcgaccgtgtattcgatattgaatctggcattgtagcgggctggtacaaaaatgtcaaaaatacgaatccgctgttggttactccgtatttgcctgaattgacaggccatcccggaacagaggtggtgctcggaaagcacagcggcggtccctctatcgattgctgggcggaccggctgcatatcaaattggataaagaacaaaaaagcgatctgctcggccaaataaaattggcggcttgcaaaaagggaaatacccttgacgaacaggaggtccgtttgctctttaaacaatatcaataacaaaaagcccggcggcctgaaaccttcctgaaaagcaggaatcggattcagtccgccgggctttagggcttttatgggaaaccgcttctatcgcacgggatgcttttttattgcccggtaaaaaagcatgggacttatattgcatattgcagaaaacccgggcgcttaagatgtcaaaacatgcgggcggaaactttagaaaaacaaaagatctggaacgacaactagctccagatcttttgtatggtgccggtggcgggggtcgaacccgcaccctgttgccaggactggattttgagtccagcacgtctgccaattccatcacaccggcgaatgctatattagtatagcaaaacagaatgaaaaaggcaagccttttcggaaaaaaacggaacacaataaaaggtcataaaatatttacaattgttacgttcttgttttcctgcatttgaactgctatgatattttccgtttaaataaggaggggaaggttctttgtccgaaaaaaccaagagaatcagcagaattatattaacaaataccatacgctttggattgatcctgggatttgtccttggctttgctgctttgtttggtcagaccaatgtcctggccggcgtggcgctggttgtggggctgttgatgtttccggtatgtgatttggggctccgtcctggctgcgccgcgcttttgatcctggccttgtatccgatatgcgggatcgtcgcgtcgctgcctcgtccgggtttgttggctgggatgctgattgattttatatttgtatgtttgctgatggttttatttgctgaaccggcgatgttgaaaccacacatcaatttcttgctttgctttctgttttgccggtcggcgcctgtggcaggccgcgattttatactgcggattttgggcctgattgccggcggcacgctgattgcagcggcgatgctcatttttcaaaaacgagcgaaaaatatttcgcagaggcgcacgcttcgcgcgcagatcgacctatgtatttcaaacaatcgtgcgtttattcttcggatggcgataggaatcgcattggcaatagcggccggtgaggcgctgcatttgaaaaaatcgctttggattaccattgtggtcatgtcgttgacacagccagcgttttgtgacgctgtccagcgcatacggcaccgcgtctgtgcgacagttgtcggaatcgctttgttcacaattctgtttgatctgctgattccgcagcaatatgccactgtggggattctgctgcttggctactgcggcagttttacgtctgcatatcagcatgttcagaccatcaatgcggtgtccgcgatcacggcatcgcttgtccttttggattccaccacagcggtatggaacagagtcggttgtctggcaggcggtattgtaatcgtgctgctgctttataccgcgcagcgtgcatgtgagccgcttgcagcttatctgcgcaaatacatctgtgcaaatagggagcagaacggattcaatggggacacgccctgaatgggacagggcgcggcatagagtcaccgtccgccggaacagatggttttagacgtatttacgcaggatgcttgatttttcctgcaaattacgttatgataagaagtcaatagcggtcccagcccagacgaaacgcagatgcgccccattggcggggacagtggagtccatgcgggcttttgatataggaagggatgtcaacatgagtcaggatctgttgacagtgatcaggcagatgacgccgggtttttccaagggccagcgtttgattgccggatatattgtcaatcattttgataaagctgcgtttatgacggcctcaaagctgggcgcggttgtcggcgtgagcgaatcaacagttgtgcgctttgcctctgagataggctttgaaggttatccggagcttcaaagggcgcttcaggaattgatccgcaacaagctgaccaccgtgcagaggatggacgtgacgagcgatcagctcgagaatgcggatgttctggccaaggtgctcggtaaggatattgaaaagatccgccgcacgcttgaggagacgagccgtacagattttgagcaggcggttgactcgatctgcgcggcacgcagcatctacattattggcgtgcgttccgcagccgcgcttgcgcagtttatgagcttttatttcaaccatattttcccgaatgtacgccttatcaatacgacaagccgaagcgaaatgtttgagcaaattatgcggatcggtccggacgatgtgtttatcggcatcagctttccgcgctattcgcggcgcacggtacaggcgtgtcattatgcgcgcaccaacggcgcgaaggtgattgctctgacggattcaatgcagtcgccgattgccgaaggcgccgaccacacgctcgtagcgcgcagcgatatggtttcttttatcgattcgctcgtcgcgccgctgtcgctcatcaacgcgttgattgtcgcggtcggcttgaaaaagcgcggcgaaatcgcccagacctatgaacgccttgaacggatctgggatcaatatgacgtttatgaaaagcatggggagggagccggtggcaattaaaaccatcgtaatcggcgcgggcgccgcagggctgtgctgcgctggctttctggcccgtgcgggtatgccggcgcttgtgctggaacgaggaccccggccggcccgcaaggtgcttgtcaccggaaagggccgctgtaatgtgacaaataactgtacgccggatgtttttctgaaaaatgtccggacgaacagccgctttttatatagtgcgtcgagcgccttttcgccggaggacaccatacgcctgtttgaatcgcttggcgtgccgctgaaaacggaacggggaaaccgggtattcccggtttcggaccgggccggggatattgccgacgcgctgatccgcttcgcgggtaaggattgtatacgcatgggcgcacgcgtttctcagattctggccgaggacggcgctgtgcgcggcgtgcggctggaaaatggcggaacatgtatggccgacgcggttgtactggccacgggcggcatgagctatccgggaaccggctcgaccggcgatggataccgccttgccgagcgtctcggccatacggtcgtatcgccgcgcgctgcgctcgtccctatcgaagcgagtgagaaatggtgcgctgaattgatggggttgtcgctgaaaaatgtgacgctgacgctaaaaaatgcggcgggcaaggctgtattttccgaaatgggggagatgctgtttacacatttcggcgtttcgggaccattggtgttgtcggcttcctcctatattaaggaggatcccggcgcgtatcgcatagagatcgatctaaagccggcgctcaatatgcagcagcttgacgcgcggctcctgcgggatttcgcggagaacaggaaccgggattttatcaatgcgcttgaccggctcttgccgcgcaagctgatcccggtggcggttcgattgtccggcgttgcgccggagaaaaaggtgcattccataacgcaggccgaacgccgcgctttcgcggcgcttttgaaggcgctgccggtcactccgaaggcgtttgcgccgatcgagcaggcagtgatcacttcaggtggaatcagcgctcgggagattaatcccaagagcatggagtccaagctgatcagagggctttatccgatcggcgaggtggttgacgtcgatgcgttcaccggcggattcaacctgcagattgccttttcaacagcatttctcgcggctgcggccattgctgcggccgacaatggataaagggagtaaagaagcatggtttctatcgcgatagacggtccggctggcgcaggaaaaagtacgattgcacgcgcgatcgccgaacggcttggatatatctatgtggataccggcgcgctgtatcgcgcggtcgggctatatgccaccgccaacggcatagagacaacggacgaggccggagtggagcgattgcttatgagcgcaaaggtcgagctgcgtcacgataaaagcgggacgcagcgcgtatacctcaacggatacgatgtttccgaggaaatacggcggccggaaatttccatggcggcgagcaatgtcagcgcgctgccggcggtgcggcaatttttgtttgcgcttcagcagaaccttgcaatggagcacaatgttgtgatggacggtcgcgacatcggaacggtcgtgctgccgcgcgcacaggtcaaaatttttttgacggcgtctgtggaggatcgcgcgcgcaggcgtttcgatgagttgaccgcaaagggcaggtccgtcacatatgaggaggttcttgaggatatccgaaagcgtgatgaaagcgatacaaaccgtgcgattgcgccgcttaaacaggcgcgcgacgccttactggtcgataccaccggcaacacgcttgaacggtcgatcgatatccttttaaaacttgtgaaggagcagcttgcccatgttttatagtttctgctggtggctttgtatgatctggatccgggtgatgtatcatgtagaaattgtcgggcgcgaaaatgttccgcgggatcgcggctatatcctggccgcaaatcaccgtacaaatatggatccgatctttgtggctgccggcgtgcgcgcaccgatccgctatatggcgaaggtggagctgttccagaaggggaaactgttttcctggctgctccacaggcttggagccttcccggtggaacgcggcaagggcgacacaggcgcggttgagtgggccgaacaagtggttcgcagcggcgccgtcctgggcatgtttccagaggggacgcgctcaaaggacgggacgccgggaaagcccaagtccggggtggcgatgatcgcttcacagacgaacgcttctgtgctgccatgcgccgtatgctatgggaaagaactgcgctttcgtacacggctcaccatccgctacggcccgctgattccgtatgagcgccttggtttttcacaggctaacgccgcgccgcgtgaaatcaaagccgccagccggttgattatggatgaaattgtcaggcttctggaggaacaggcatgagcgtaacggttgcaaggacggcgggcttctgctttggcgttcagcgtgcgtatgatcttgcgatggagctggtccggtccggccggcccgcctgtacttacggcgaactgatccataatccacagattgtagctaaactttacaaggcagggataccggcgattgagcgtgtagaggacaatatagacagacgtgcggtcattattcgatcgcacggagtgccgccgtcggtctatcatgcgctggctgaaatgggctgtgaggtcgtcgatgcgacctgcccatatgtgcagaagatacataagctggccgcggcatacgcaaaagacagcattattttgattgccggtgatccttcacatccggaagtacagggaatcgagggtttctgtgagcgccatttgacgtttaaaaatgctgatgagcttaaaaatttgtatccatttttggaaaaaaatagaaataaagcctttgttttactttcacaaacgactttttcagtgtcggaatgggaaaaaagtgtagaaaaacttaaaaaagtgtgtacaaaccttcgaatatttgatacaatatgtattgctactgagagacgccaacgcgaggcagggaaattggccgccgaaaacgatgcgatggtggtggtgggtggccgccgcagttcaaataccgtgaagcttgcgcagatttgtggggaattttgcgaaacttttttagtcgaatcggcaaaggaattgtatgattgcgactttaacgggcatactagggttggcgtcacagccggagcgtctacgccggcgtggattattaaggaggtacataaaaccatgagtgagattctaagggatcaggacgagctttctttcgaggagatgttgaatcagtcttttaagacgatagataacagagagaaagtaactgccgttgtgacagggatcgccccgaatgaaatttctgtcgatatcggcaccaaacacgccggttatgtcccgctgtccgagctgacagacgatccgaacgcgaagcctgaggatcttgttaaggtcggcgatacgctcgaccttctggttgtacgcgtcaacgatgtggaaggcacggttatgctctccaaaaagcgtctcgacgcgattgcaggctttgagaaggtcatgaacgctgtcgatacggatgaaatccttgagggtacagtcgtcgaggtgatcaagggcggcgtgctcgctttgaccaacggtgtgaaggtctttattcccgcctcgcaggcgaccctgtcccgcagcgacagccttgatgacctgctcaagcagaaggtcaacttcaaaatcctcgaggtcaaccgccagcgcaagcgtgcggtcggttctattcgcgctgttctgcgcgagcagcgcaaagagcttgaggacaagttctggcaggaggtcgagatcgggcgccattatacaggcgtcgttaaatcgctcacgagctacggcgcgtttgtcaaccttggcggcgtggacggcatggttcatatttccgagttgagctggcaccgtattaagcatccgtccgaggtcgtcaatgtgggcgacacggttgatgtatacatcaaggatattgacgcggaaaacaagaaaatttctcttggcttcaaaaaggccgaggacaacccgtgggaaatcatgaagaaggattatgcggtcggtacggtctgcacggtcaaggttgtctccatgacgccgttcggcgcttttgcgcagattatcccgggcatcgacggtctgattcatatcagccagatttcaaatgagcgcgtcaataagccctccgatgtactttcgatcggccaggaggtcgaggtcaagatcaccgagcttgatacggaaaagaagcgtgtcagcctgtcgatccgcgcgctgaacgaggacaagaagcagcaggaagaagcgcaggagcctgtcaatgaggaatccggcgtcgtctatgaggccggtccttctgaggcgtaaaacgaaacagattttttgcggcgcgggttttcccgcgccgctttgacgtttttggctgtgtatcatttgaaacatcgttcctgcccgcatcgcttacatcagaaggcttgcaggcggatattgtgttttatgcaaaaaagtggtacaatcatttcattcatattgatgatatgacctgggcgcgccgccgcgcgggggcgtatcataaacgggggaatcgatgtgccgatcaaacgctggaatatccggcaggccgacgacgaagccgcgcggcatgcagcgaaggcgcttggactgccgccgctggcggttcggattttggctggcagaggctttgatacacaggaagcaatcaggcggtttttgacaggggattgcgccctgaccgatccgatggcgctgcgcgatatggacagggcggtgaagcgcatccggcgggcgattgcagaaggtgaaaaaatcgctgtttacggagattatgattgcgacgggatactgtcgaccgtcgtgctttacagttatcttgagtcggccggggccgacgtttgttattatattccgcatcgcgacagggaaggctacggcctgaaccgcgaggctttgcagatcattcgtgacgacggtgtgcggcttgtgatcacggttgacaatggaattacagctgtcgacgaggttgcttttgccgcctccatcggcatagacgttgttgtcaccgaccatcataaaccgcgcgatatgctgccgcaggcagtagcagttgtcgatccccatcgcctggacgatgaaagcggctgtgaatacctcgccggaatcggcgtggcgttcaagcttatttgtgcgttggagggcgacgatggtgatttgatgcttgagcagtatggcgatctgatcgccgtagccacagttgcagatatcgtaccgctcatcggcgagaacaggaccattgtacggcgcggtctggaaagcctgcaaagcacggataacgagggcttggccgcgctgatccgcgtttgcggcatggcggaccggcagttgtcgtgtgaaaatattgcgtatgggattgtgccgcgtatcaattcagccggccggtttgactgcgtcgacaatgctgtcgagcttttttcgggcggctgtgacgagccggaaacactcgccggcgacatcaattcactcaatgagaagcgccgcgcagtcgaggatcagatagtgcggcaaataatgaaccagcttgatgcgcagacagaggaacttggccgccgtatcattgtgatccatggcgagggctggcaccacggcgtcgtgggaattgtcgcttcccgtatggtggaacggttcggcaagccctgcattgttttttctgttgaaggggatgtggcgcgcggttccgcgcgcagcatcgaaggcttttcgattattgacgcaatcgacgcctgttcgcggcttttgatccgttatggaggccataatcaggcggccggactgacggtatcaatggcaaatctcaaggcgtttaaaaatgcaatcaacgattgggcggcttctcactatcccgatatgccgcagcagacaatcaacatcgactgtgctatttcgccgcgccagttaacagttgaggagatcgcgccgctgtctatgctggagccgtttggctcaggaaacgaaccgcctgtctttacaatccgcagctgtgttttgcagggaatttatgcaatcggcgacggcaagcatgtacggctgcgtttctgtggggacggatgtgtattttatgccgtttactttggtatgacgcaggccaattttccttatacaatcggtgaaacagtggatttggcggttacggttgatgtaaatgaatggaatggggagcagcgcgtttccgtcaaggtgcgcgatatccacctttccggaatagactatgataaaatccatcattccgaacaggtgtaccagcgtcttgtgcgcagcgagccggtcgagccgccggcgcgggcggccgcagtgcccgatcgggaggatattgcggtggtataccgttatctgcgtacaaaaggaaatctgcgcgcgccggatgaaatgatctatgcaaaattacagggcaatatttcgtgcctgtgtaaggtcaagatcgcaatcgatgtgctcgatgaaatgcatttgatcacccgggaacacagcgggggcacaaaaaacgtcgccgttgtggccaatccgcgcaaggtggatatctcccaatccaagattctgcgcgggcttgcaaagcccgccgcggggcgtgaatgacgccccttctgcgggcttcggcccgcaatggaggccttgtcagatgaattactatgttatagacgatttgcagcgggcgatcgaccggagcggccgcgtgtatgaccgcgaaaagatcatggcagcctatcagcttgccaatgacgctcataatgggcagtgccgcgtttccggcgagccgtatatttcgcatccgattgcggttgcgattatccttgtcgacctgggtatggacagcgaatgtatccaggccgcgctgctgcatgacgttgtggaagatacggatatcacaagcgaggcggttgaaaagcagtttggtaccgatgtggcgctgctggtcaacggtgtgacaaaactcggaaagatcagctttacatcgcgcgaggagcagcaggcggaaaatgtgcggaaaatgcttttggcgatggcgcaggatgtacgcgtcatcatcatcaagctggcggaccgcctgcacaatatgcgcacgatcgaggtgatgcccgaacagaagcggcgcgataaggcgcttgaaaccatggaggtttatgcgccgctggcacaccggcttggtatccgggcagtcaaggaggaattggaggacatctccctgcgctatcttgatcctgtggcctaccatgagattgaatcaatgctggagcttaaacgcgccgaccgccaaagctttttggagaagatcaaggataaaattcgcgagcggctggcggcagaatacaacgatatttatgtcgatggacgtgttaagagcgtttatggcatctatcgcaaaatgtatattcagggaaaagcgtttgaagaaattttcgatatttatgcagtgcgcattatcgtcgattctgtcaatgaatgctacaatatcctgggcatcatccacgacctgttccggccgctgccaaaccggtttaaggattatatttccacacccaagccgaatatgtatcaatctctgcatacgacggtcatcgataaggaggcgataccgttcgaggtacagattcgtacctgggatatgcaccacaccgctgaatacggcatcgcggcgcactggaagtataaagccggcgtcaccggacgcgacaagctggaggagcggcttgcgtggattcgccagttgattgaaaaccagaaggaagctgacgacgtagaggatattgtgcggtcgattaaaagcgatctttcgcccgaggaggtatttgtgttcactccgaagggcgatgtcatcagcctgcctgtcggctcgacggtgatcgactttgcatacgctattcataccgaggtcggcaaccggatggtcggcgcgaaaatcgacgggcgcattgtcgcgctcgatacgccggtgcgtaccggtcagatcatcgaggttgtcacgacgaacgcgaaggatcatgcgccaagccgcgactggcttaaaatcgtcaaaacgacagaggcgcgcaacaagatccgcaactggtataaaaaggaacgccgcgaggaaaacatcgagcagggccgcagcgagcttgaaaaggaattccgccgcaatatgatcacgctgcccgacggaaagctgccggagtttttgtcggcgatcgccaagcggcagcacttcgagcttgctgacgattttctggccgccattggatatggcggcgtgctgctttcaaaaatcatgccgcgcatcaaggaaacgtttatccgcatgtaccgcacagacccgcacgcggcgcccagcccggcgcctgttaagcagcatcgtgtcagaggcgcgtcgggcggcgtcatcgtggaagggcttgacagttgcctggtcaaatttgcgcgctgctgcaacccgcttccaggcgacgagatcatcgggtttgtcacgcgcggattcggggtttcaatccacaaaaaagattgccccaacgtgatcaattcaatcaatgacccaaacaacgccgaacgttgggtgcgcgccgaatgggcgctcgaccaggccaagcgcgagcacttcaagagcacaatcgaaattgtcacggacgaccgcttgggcgctttggccgatatctccgtcgctctttcttcgatgcgcatttcaatcagcacgctgatggcgcgcgaagtaaaaacaggcgagaacgtcgtcacggtaacatttaccgtcagcgacatcgatcagctcaattttattatcaacaatctcaagaagattcccggtgtggagcgcgtcacacggtctgcgcagtgagacaccggaataaactggaaggagggctttgattgaaggcagttttgcagcgtgtctcgtctgcatccgtcagaatcggcgatgaggtcgtcgggaaaatcggtcaggggcttgctgtgttgctcggcgttgtcgacggcgacggcgtggaggaagccgattttctggcggaaaaggcggctaacctgcgtatttttggagacgagcaggggaagatgaaccgatctctgcttgatatcggcggcgggatgctcgttgtctcaaatttcacactgtgcgccgatacgcgccacggccgccgtccgtcgttcaccggggctgccgggccgaaaacggccgattcgctctatctgcggttcgtggcggcggtcaaagacacgggtgttacgtctgtgcagaccggtcgttttggtgcggatatgctcgtttccattgaaaacgacgggccggtgacggtcatcctcgacaccgatgaaatcatgaagcggccagggaaggtttgaaaggaaaacagccgaatcgttccgttcaaacaggacccaaatcgtgaaggagaagcaatcatgaaaatatacaccatgcctgtcggaacgatgggcacaaactgttatatcgcggcggacggcgatgtctgcgctgtgatcgatccaggttttcaggctgaaaagctgatttcgtttctgcgcgggcagaagcttcggccggaatatattctgctgacacacggccactacgatcatatcggcgcggtgcgcgcgctgcgcgacacattcggctgcaagctggcgatcggacgcggcgacgaggagatgctggccgaccgcaaaaaaagtttggcgatcatgcgcggcatgactgatgaggactacatcctgacgcccgacgagcgtctcgatgagggcgacagggtcacagtcggcggcatgacatttgaggtgatcgacacgccgggacatacggccggcggcgtgacttaccggtgcggcgacgttctctttacaggcgacacgttgtttgcgggagatatcggccgcatcgacttgtatggcggcgattacgaggaaatgatggcgtcgctgcaaaagctttcgaagctggaaggcgattaccgcgtgctgcccggtcatgggcctgaaacgacgcttgcgcgcgagcgcagaagcaacccatacatcaacaggaaaccgggctatgacgctttttattgaggggcacgcgttcggttacgagttgtcgcgcgtcgcgcagatgttttttcccggggagaaggtcgtctttcaggagggagcgccctgcggcgcgccggccctcggcgcgcgcctgtgcggcggcgtgctgacggtttcttatcgggaggcgtcggggcggctgcacagcgcgccggaagaaacggcggcgccgggctgcacgccaggggaaatggaacacatgtttggcgtgatgctgtaccgcctgctgtcgcgggcgacgggggtctgtccgccgtggggcgtactgacgggcgtgcgtcccgtgcggctgttcatgacagagcttatgcgcggcgcggacgacggcgcacttcgcaggcggtttatggacggcagtcttgtgagcggggaaaaatttgacctcgcgctgcaaacagcgcgtattgaacagccgctgctctcccgttcaacgcctgacagcttttcgctgtatgtttccgtgccgttctgtccgacacgctgcgcgtactgttcgtttgtttcgcagtcggtcgaacgcgacgcggcgttgattcccgcgtatgtggacaggctctgcgaggaactggaatacacaggctgtctggcaaaggagttggggctgcgtctgcgcacggtttatttcggaggcgggacgccgacaacgttgtcagccgaagatttgactcgcgtgatgggaacggttgcagacaggttcgacctgtccgggctgtgggaatacacggtggaggcgggacggcccgatacggtcacgcctcaaaagctgcgcgctatctatgccggcggagcgcggcgtgtgagcatcaacccgcagacgctttcggatacagtgctttgcgccatcggccgccgccacacgtcggcacagttttttgaagcgtttgcaatggcgcgcgcggctggctttgactgtatcaacaccgacctgatcgccggacttcccgccgatactccggagggctttgccgcaagcgtggacggtgtgcttgcgctccatccggaaaacgtcaccgtccatacgctgacggtcaaacgcgcgtcgcggttgacctttgacgaagcgcgcagcgagctggagcttgtcggcggcatggttggctatgcccgaaacgcatgtgtagcggccggcctgcatccatattacctctatcgccaaacgggcacgctggccagtcttgagaacgtcggctatgccgctgtgggaacagagggcctttacaatacatacattatggacgaaacacatacgattcttgctgttggcgcgggcgcttcgacaaagctgcgccacccgaaaacgggcaggatcgagcgggtgtacaattataagcacccgacagagtatattgggcgctttgacgaggcgctgcgccgcaagcagcgcgtacgcctgttttatcaggacagcggcttgtaaatatcggacggatggtgtataatgcatactaattcaaaggataggaggctttcagcatgggaaaatttgacgaactgattataaaggcaaaagatttggcaggtgtcgctggcagcaaagcgcaggaggttgcggagcaggcaaaactgcgcatgcagattacgcagatgaaaagccagatcgacgcaaattatctcaagcttggcgaaataatctatgagctgaacaagtccggcacgcagaatgaggaactcgtcgggatgtgcgttgccgagattgagacacagctcgcagagcttgcagagctgaaggacaagctggacgagatgcgcaaggttttgcgctgcccggactgtatgtcagagaatccgcgcgatgcgctctactgctcgcactgcggcgcgtcgcttaaggggcagtcgcccactgcgcctgaggacagcggcgaagtcaatgaggaagctgcgccggaggagacggcggccggcgcccaagcgccaacagcggcggccattgacgagccaaaggagtaaacggatcgatgaaaggcccggatggtcatccgggcctttatctcagcaaagtgaatgtttgagatgtacagatatatagacagcttttgttaaaggatgggagtatggaagcaagaaaagaaaacaaaatggggatacagcctgttggaaagcttttggtatccatgtcgctgccggtgatggtatcgatgctgattcaggcgctatacaacattgtagacagcgtgtttgtctccagaatcagcgaaaacgctctgacagccgtgtctttagcatttccgattcaaaatctgatcattgctgtagcggtcggcacaggcgttggcatcaattcgttattgtcacggcggctgggcgaacgcaattttgaggacgccaacgcagccgctgaaaacggcattatgctcgcagtgttgagctggattgtttttgcgattgtcggcggtttgttttccgacgactttttccgcatgtttacctctaacccggagatcgtcgaaatgggcacgcagtatctaagcgtctgctgcgtattctcgttcggctgttttttgcagcttgcaacggagcgtattatgcaggctacgggtgtgacgatctttaatatgatcacacagggcatcggtgcgattacgaatataatcctcgatccaattttgattttcggcttgctcggtatgcctaaaatgggtgtaaagggcgccgccgtcgctacggttgcgggtcagattctcgcaatggcgctcgggctgctgtttaatcatctgtttaaccatgaagtacatatgaatttcttgaagttccgtccaaattggcgcatcgttcgtgagatttacaaggtcggcgtcccgtcgatcgtcatgcagtcgatcgcaacgcttatgaccggcggtatgaataagattctgatcgtattttcagagacggccgtttcggtattcggcatctactttaagctgcaaagcttcgtattcatgccggtattcggtctgacgaacggattgattccgattgtggcgtataattttggcgcgggcaaaaaggagcgcattataaaagcgatccgcctggcatgcatctatgcgctcgcaatcatgctggccggaatgattgtgtttattgctttcccggcgcagatgatcggcatgttcgcttcctcggaggagtcattgggcgcgatggtggcaatcggtgttcccgctctcaggctgatcagcttaagctttcttggcgcggcagttggaattgtgttgtcatctgtctttcaggcggttggaaacgggatgtacagcttgattatgtccctgacacgtcaattggccatactgctgccggtcgcctgggtgatggcgcgctttgtgagcctggacgcggtttggctggcgttcccgattgcggagatggtttcgctttgtctggcgcttgtgatgtaccggagaatctatcacaggcagatcagcacgctcaagacgacgccttgaaggaggatggctaaaagcccctcacgccgctttaaatgcggcgtgaggggcttttgtctcaaatgcgttcgaccagccccaacgtcagtttggcacaacggtgcgccgcctgttcgacaaaggtgtcgaaatccatctctccgttgtcgtccgcgccgtctgagatacagcgcaggatggcaaacggcagattattgaggtaacagacatgtccgaccgccgcgccttccatctctgtcgcgtcgccatgcgtgtcggaaatgatacgcgctttgacgatggaatctgtgatgaactggtcgccggatacaacgcgcccgcggatacaatgcagcctcagttcggtgcagacggtttccgccagctccgcgagccgcgcgtccgtggggaaacaatcacagtttgggaaattgtccctgagcagagaggcggggaacaggtcgtgatacatgacatcgtttgcaacaatgatatcaaaaatatgcagcttgtccgataatgcgcctgcgacgccgctgaacacgatgcattcgacaccgaaattggaaatcatcatctgtgcgcaggccgccgcgttgaccttgccgatgccgcctgtcgccgcgataatgtccttgccggcatattcggcgcagtaaaacgtgcagcgtcctatctgcgcggtgcgcccatgggccagggcctgcttgataagcgcgaattcattgtccatcgcgcagatgataccgatttttttcataaatagacctcccgtcgattgcttacaataaatctattttatcggattggccatgggaatgcaaggccaggctggtcataatgcggcgcatgtgataatataagtgtaatgacgcacggcggcagccgcgcgtttgatgaatgtttctgcccggttttgacacaataggagctgttgacatgggaagggccgtaaaacgcagactctgtcaacagaatcgcatatcggggaaagctaaggagcgtggatacatggaacagcgccgtggacatggctatctttacggcacaatggtattggcggttgggacggtcattgtcaagttgatcggcgtatttttcaaaatcccgctgacaaatattctcggcggcgtcggtatgagctatttcaacgtcgcctacgagctttactatcctctttacgcgctgtttgtttcaggcgtaccggtggccgtttccaagctggtcagcgaaagcgtcgccaagggacgcgcgcgcgacgcggaaaaattgctacgcttgtctgtaggcgcttttgtcgtaattgggatcgtgggttccgctctgatgtattttggggcgggctggttttcccagcgtgtcaacaatccaccggcggcgctcgctgtgcgtatgctttcacccgcgctgcttttcggctgcgtgatggcggcgctgcgcggttattggcaggggatgcagaatatggttccaacggccgtctcgcaggtcgtagaggcagtggcaaagcttgtgctgggactgacgcttgcatacgcggcgacagccataggaatggctgaatatgcgcgtgccggcaccgtattcggggcgccgtgcgattccgccgagcaggcgcagattgcggttcttccgtatgcggcggcgggtgcgatcctgggcgtgacgctcagtatggcgtgcggctcgctttatatgctgacacgccggcgcgtccgtgtggataaggcggccccgccgcctgcgccgggcggagagctgctgcacaggctggccgcgatcgcgatcccggtttgtgttgcgtccgtaatcgcgaatctgacctcgtttatagatctgatttccgtgatgaaccgattgaccgcggcgatcgggcgcgcgccgcaaactgtttggggcatgtatgacggcatgattccggccggcgtcgatcagggaatgctcgcttcatatctgtatggatgctactcaggtcttgcggttccggtttataacctggttccatccctgacagcgaccatcggcatcagcctgctgcccgctgtttccgccgcttgggcgacgcgcaacagtcgcgtgtttgagcagaacgctgcgtcggcgctgcggatcgcatcgctcattgcgatgccggctggtatcggtatctgcgtactcgccggcccggtcatgcggctcttatatttctccaagccaatggaggcggctgtaatcgcgcctgccctgcgttttatgggcctcagcgcgatctttgtggcggtttcgctgccggtcaatgccattttgcaggcaatcggccgcgccgacctgccggttaaactgctgtttgccggtgggctgatgaagttggcgctcaattttgttttggtcgcaatcccgcagctcaatatacaggccgcgcccatcgggacgcttgtctgctactgttttgtgctttttgtcagcctgtcccggttggtaaatttgaccagcgtgcgcatccgggtgctccctgtttttgggaaaccgctttttgccgccgtttgctgcggagccgccgcatgggccgcaaacggccttctggagcggatttgcgggggaacgatcgctacgatgggagcggtggcggccggcgccgcgacatatctggcggttgtactgctgacacggacattaacgaaggaggacgttaccatgctgccgggcggagaaaagtttgcaaagctacttgaaaagcggtcccttttagggtagaatacttaagtaccgctaaaatggcttgaaaagggggcttgcgccgatgccggccgcttttgaacgcaaggcgtcctacaggatcgaggatctgctgcgcatcatggaaatactgcgttccaaggaaggctgtccttgggaccgggaacaggatcaccattccatccgcaaaaattttgttgaggaaacatatgaggcctgcgaagcgattgaccgcgaggacacggatttgctgcgcgaggaattgggcgacgtgcttttgcagattgtgtttcacgcgcgcatggaggaggaggcaggctcgttttgctttgacgatgtctgcgacggcatctgcaagaagctgatcctgcggcatccgcatgtatttggcgatacgcaggtttcagggagcggagatgtgctcgttaactgggatcggatcaagcaggagagcaaagggcagaaaacggcggccgagacgcttagaagcgtcagcccggcgcttccggcgctgatgcgcagcgagaaggtgcagcaccgcgcggccaaggttgggttcgattatccaagcggcgcgatggcgcttgacgatcttgccagcgaattggacgagctgcgggaggcggtcgcggaaaacgccgccgcgcatatcgacgaggagcttggcgatctgctgttcgccgcggtcaatgtttcccgctttgccgggattgatgcggaggagagcttaaaccgcgcctgtaataagtttatcggccggtttacaaacgttgaacagctcgctgcacagcgggggatcgatatgaaagcttcgtcgattgaaaagctggacgagctttggcgtgaagcgaagcgtatgaatcgatgagcgttttgtccaggcatttaatgtctgaagatatatttattttatggagggcttttaaaaatgacgaaagcagaattgattaccgctgttgcggaaaaatcgggactttctaaaaaggacagcgaaaaagctgtcggcgcgatcgtagagacgatcaccgaggcactgaaagcgggcgataaggtcgcgcttgtcgggttcggcacctttgagacaaagcaccgcaaggaacgccagggcatcaacccgatcacccagaagccgattacgatcgcggcggcgacagttcctgcgttcagcgcgggaaaagctctcaaggatgctgtcgccggcaagtaaggtaaaaagccacatgcaggggggtgagggcctgccgcttcgcggcaggcttttgccatacatgcgtctgtttctgtgacggaggattttttgtgagacttgataaatatttgaaggtgacgcgcttgatcaaacggcgcaccgttgccaatgaggcctgcgacgctggacgcattgtggtcaatggcaaggttgcgcgcgcttcctacgatgtgaaggagggcgacgtcatcgaaattaatcttgggcagaagccgctgaaagtaaaggtcgtcaaggtcagcgaatatgcgacaaaggacacggccgccgaagcatacaccgtgattgagtaggaacaaaaaagggcatggcgcggaatattatccgcgccatgccctttttagatggaacgtattaccttggtgttgtcagcaaagcgtcaagcggctttccctgtgcccaaggcatcgaaagcccaagcagacgcgcaattgtgaccggttcatcgatcaggtcggcctgttccacaagcgcgccctgccggacgtcgggacctttcagcgcgaaaaagggggattgaccgcgggcggggtcgtgcccgtggttggcccgataggaaaggcccgcgtccgttaaggaacacatgagggaatccccttcccattcatcacggaacagtacgccgggcgccccctcgagcacaaacgagaacggcccgtccagatggaacagtttctttgcctggctgcggtcatatacagccgcaatgcccaggtactcacgtattctttcgtcgttcaacatggcatggacagcgggaacatccgatgggtcggcgacatagacctgtgcagaacagcaggccgaatgcgactgcgcccgccaatgcaagctgtccgatcccgtttccggtgtcagaaatccgcgttttcgcagcagcacatttggataggacgcgcggtcgacagggagttgaccatgatcgctgcaaagtgcgaccgttgtctcctccaggattccgagagcgtcaagctcacgcagcaggccgtccaaaagacggcctgtgcgcttgacagcctcccatacctgcgtcgagtcaagccccccgtaatgcttggcgttgtcgatctggcagacatgcgcatagatcagcggcggattgcccatatggatgacacggcgcaaacatgcaaaaacaaattcatcaagcatcggctgttggaagcctcgcgggatggaaccgacctccggccagatttcgcggatgaacggcgcgctgccggccctgcacattggttcaaaaaaaccgctgtcggggtcgccgtcccaaatttccgggatcagataatcgacaggggcgtttcccatgcacggccagaggatacagccggaacgcaggccggccgcgcgcgccgcatggaaaatggtggggcggcgaatttgatcgtgatagaagatccacggccttcggcgggtttcaggcaaaaacaattcgttgttaaacacgccgctttcctctggccagcagccgcaggccatggcggcatggcagggataggtcagcgacggatagacgcttcggatatggcgcgccagcgcgccgcgttcccagaaccatgaaaaccctggcaggtcacgggctttggaaaaatcctcaaaagtcatggcatccaaagagagaacgatcactttatgagataactgcttgggcatgaaaagacctcccaacgtgtaaacggatagtagatttatataatattatttattttttgtcaaatctcaaaatgaatttagtaaaattggttgacaagaacaaaataaagtgttacccttagattacagaaaactgtatattgtttttatacgaaagggggagcgtattgagagggttgaccaacaagcaggacgcggtgcggcgagccctggcgcgtgaatttatcaccatggttttccgcggggaaaacaacaagctctccgggatcaaggaatatgcggaccgcttcggcgtcggcgcgggaacggtgcagggtgcgctggctgatttgaaggccgcgggagccgtttccctaaaggcctgcggcgcacagggaacatacatagaaagcgccgaccgcagccgccttttggagatgtgcgagtacgatatttttatcgggctgctcccgctcgacagcagcctgtgcgtcaaaggaatggctaccggtattttcgaagcattcaccgaataccgcctgccgattcatatcctgttcgcccgcggatcccgtaaccgagccggaatattgctgcgtgaaaagtgcgactttgttgtgatgagcctgtgcgcatattcatatatgcacaagaatgcccgtgacgagcgccgcgatctttgttccatcggtacgatcagcggctatccaagcgagcatgtatttatcacaaagagggacgcgccattctccatggcggagacacaggtggcatacgacgcattctcctacgaccagatagccattatggaaagtctgggaaagcagcacaaccgttatggcgaatgtctcggcgtccagttgccggagctggtgcggcgcggcgaagtggagtccgcgctcgtggaacgaaaaagtctgggatgcgcggatgattttgacgttcatcccatagagcacttgccgccacagatgcaaagagatctgggtgaaagtgtggtcgcggttcgcggcagcgatcacaacctgtccgatctgttgagtctggtgctgacttccggcctggttcgtcaggtgcagcaggagattttggatgaaaaacggatcgtcacatattgacgtgagcttgggtgttttgttaagaagggtatacatatgcagaaatatatcggcggtatagaagggttcctggagcaggacgccgcaaaggagtcggctttctgggcggattatcaggtgctcggtcccatgtttgcggctctgcgcatgtttatgacaatggacgatgtgctgacggtgatcgtaggcgccaaaggctgcgcgtatcatctcaattttacaattgtggcgtggggagagatcgactttttcctgggaaaacgtccgttgcccgtgctggagtaccggcagcagcaaattgcactgggcgattttaccccgcctgaggactggcttcgccgcatgaaaaagttgtgcggcgtctatagagccagacggatcgtccttttgcccacggacgcgctgcttctgtgcggcgccgaccttgcaggcgttgcaggagagattcaaaaattcaccggaattcagaccgaggctctggaaatcgcggggatgtcgagtcccaatcagtgggcgggctacgacgccgctctggaggctctctatcgtccgtatctcggcaagtcctaccggcatgaaaaatcggtcaacctggtgggctggatgtggccgtcgcgccacaggggacatgaaatcggatgctgtatcgatatgctcaaagagcttcaaattccggtgaatgcggtgatttccggcggttcctccctggcggacattgaaaagagtatgcacgccggtgcgaacgcgcttgtctgctcgtcggtgatggggaacttgctccaacgccttgacgaggaggggattcgccttgcggggccgcgcgcgccgtacggcttttccggaacgcgcgaatggctcacaagcattgcggatgtattggagctgccggtttatgatggcatcgacgcgatggaaaagcggtacagggacttgttcgagaagaaccgggagcagctcaggggcaagaaggtttttgtcagcggcggcccgggccgcctgatcggcttgctgcacacattggccgactatgggatggatatccaggcggcagccatgttctggcctcatgcgtggagccaggaggatatccgccacatgctgcgggatcacggcgttaaaatgaaggaattcattctttcgccaggtctggatgatctggagcgcgtcgcctgtcaatacgacgtggatgtctggctcggcggctatcaggagcagcacacctgcaagcggcatgggatcccattcgtcccgatcaccgtttacacggttccgcatgtgggctttgagggggctgtcaaccttggaaacaagctgctgttggcgatgtccggttattcctttacagaaagccagtttatagcaagggaggtagagggcgtcatatgtccatcgaacgactcgaaccaatgactggatgcgggatcttggggatactgaagtgcttggccggcatctctggcgtactcccgttgatccatggaccggtgagctgctcctccggccatcgtctggcgatgctctacgcagatgtggagccgcttcttccgacaacggccgtagtggaaagggatatggcgctgggcgcgcgcgataagctgcgggaggctctgatcgaagcgtggcggcagtatcacccgggtctgctcgcggtgatcctgacatgcgccaccagtcttgttgaggaggaatatgaaagcatcctgctggattatgaaaggcaaaccggcggcgccgctgttttgctggacggcagcggcttggcgggcgatgagacggacgcgcccggcgcggtttatgacgcgttgtaccgaaagctgaggatcgtaccggccgccagcggagaattcctggcattggaagggcttccgctgacggattacaaccgcagggacaattttccggctctttgggaattaattgaaaccgggattggatgccgtgtcacaccagggcttttttccggcatttccctgccggagctgtccgcggattaccgtgtggcgggcaaagtctttaccgggcttttgtggcgccggtcggagccggactcagccgcgccgttcggcgcggcggggagcaggcgttttttggagtggctggctggacagacaggacggcgcggactgacgccgcatgggttggatgcatatgaccgcgctgtgaaagagcttgaaccgctcgcgcaaaagctccgctctcatgcggttcccgttgccattgaggcggccggctggtatggctacggcctggcggatttcctcaccaatgagcttggctgccgtgtacttctctgtgtggatcgtgcgcacccaaagaaacccgagcgtccaatatgcgaggaattttatgaggatgtcggccggtgggagctggtcgagctgatgaaagcgtttggagccaggcttgtattcggctcatccaatgttcgttctgacgataactgggactatattcctttttttgcccctgtttggaggactgaagaaccaattggcgcactgcttggatacgagggcgcactgaccattgcgaatcggctgctgaagcttgcggagggggcgccatgaaaaagcggattgcgctctatggaaagggcggcatcggaaagacgaccgtggcggtcaataccgcgctgtgcatggcgcggcgcgggtaccgggttctgctggtaggatgcgatccaaagcaggatacgacacgtcttttgacaaagcagccgctgatctccattttggagcggtacgatgggccgtgcgggccgtctttgcaggacgggctgatcgccaacccgcggcccaatctgtggtgctgcgaagccggcggcccgaaaccgggcgttggatgcgcggggcggggcatcgcgatcgccctgaacgcgcttgaaaaagcaggttggtttgaccgtgtcgacgttgtgctgtacgacgttttgggcgatgtggtgtgcggcggcttttcaacgccggttacaaaggggtatgcgcgggaactctatattgtgacatcgggcgaacaggcgtcgctgttcgcggccaataatattcttgcaggtatgcagggccttggcgcctgtgtcagaggactgatatatcaggaacggcgctttacaggcgaggatgctcttattgagacattcagccggcgtgttaatgtacctgtcgcggtgaagatcggattttccgagcggatcaagctgtgcgagatgcatgatatggccgtgagcgaggaggaacgcgccggagttgaaacagcacagttcatggctttggctgaacggatgctgactgaaagcggtccgccagccgagatctatccaatggacaggacgcaattgagtcaattcatacgtgaatgtatgccgtcggttgcaggcggtaaggggggagaatcctgatgacgaaggaacaacctgttttgacgctttcacatgtgacaacgagtttccaaacggcgcatgggctgctgccggctgtggatgatgtcggcttttcggttttcccccgtgaaatcgtagcggttgtgggcgaatcaggttccggcaagacggtaacatgcttgtcggtgatcgggctggccggcgcgtcggctgtgacaacgggcagcattgtttttgacgggcgggagcttgtggggctgccctccgacgagctgcggcaggtgcgcggcggcgagatcgggtttgtgtttcaggagccgatgacaagcctcaatcccgtttttaccgtcggcaaccagttggacgagacgctgcgcgcccacacaaaactgtcgaaggagcagcgcaaacaacgtatcatacatctgtttgagctttgcggcattccggagcctgaacagcggatgcgctgttatccatatgagctttcaggaggaatgaagcagcgtgtgatgattgcgatggcgctttgctgcgatccaaaaatactgattgcggacgagccgaccaccgcgcttgacgtgaccattcaggcacaggtattggggcttctgcgcacgctgcgcgatcagctcggaatgtcgattgtgattgtaacgcacgaccttggggtcgtcgcaaactttgcggaacgggtcgtggtgatgtacgctggaaagattgtggaggagggaccgacccgtgaagtgcttgaccatccgcgccattgttatacgcgcggtctgatcgcatcgattccccgcctgacaacacagcgtgggcaggatcttccggtgatcccgggcaatgttccggatctttcacaaatgcccgagggatgccggttcgcgccgcgctgcggcgcggcgacggaccgctgcaaacagcagccgccggaaatcgttgtaggtcccggccaccgcgcaagctgttggcttgaggagcaaaaggagggaacggcgtatggcgcggactgatcaaccgcttgtgaaagcggagcatattgtcaagcatttcccaatccgcggcggggtgtttttacgacaggtggacagcgtcaaggcggtcaacgacgtttcgctggaaatccgcgagggggagacatatggcctggtgggggaatcgggctgcggcaaatcgacgcttggcagcgtgctgctcggacttgagcagccgacttcgggcagagtgctgttcgatggcgtagacctgacggcctgttcccggcaaaagcggcgggagctgcgccggcagattcaggttgtgtttcaagacccatatgaatccttaaacccgcgtatgactgtcggggagattgtttcggagggcctgcgcattcaagggggctgttccgcgcaggaacgccgtgagcgtgtgcttcaaattctggagcaggtcggcctttctaaagagcattacgggcgctatccgcatgaattttccggcggccagcggcagcgtatcggcatagcccgcgctctgatcgtcaacccgcgctttatcgtgtgcgacgagccggtttccgcgctggatgtttccgtacaggcccagatcatcaatctgctgcgcgatttgcagcgcaggcatggctttgcatatttattcatcgcccatggcctgaacgtcgtcaaatatctcagcgggcgtatcggcgtgatgtatctggggcagcttgtggaggaggccggttcggacgcgctgtttgaccatccgcgccatccgtatacacaggcgcttttaaaggcgatcccggacatcgacgcggtatccggcgcctttgaacagacgcttggaggcgatgttccaagcccggttcatctgccggacggctgtccctttcatccgcggtgcgcgcaccgcatggagatctgctcatccgcgcttgctcctgttgtaagcttcggtgaggaaatggtgcgctgccacctgtattcacagtccgacgccgccccggatgggcggaaaataccatagatgccataataaggaggatcattatgttgcattctgtcaagacgaggctttttgcggcggcgctttgcggcgcgatgctgttgaccaccgcatgcggcggctccgcagcgggagggaccggttctgccgctgcttccggtgcgggagatgcttcggccgcgtcgtccggaaccgcggaaacaggagagacgggcggtccgaagtacggcggcacgctgacgacctatacgtcggccgacccgaaaagctttgacccggccgccttgagtgcatgggaccagacaatcgtggcggcaaacatccttgagggcctggtgcgtttaaatcctgagggcaacgcaattgagcctggtatcgcggagagctgggagccatccgaggatggaacagtctggacatttcatctgcgcgatgcgaagttccacaatggccgcgcggtgacagcgcaggatttcaaatattcctttgagcgtgtcgccaatccgcagacagcttctccagccgcatggatgctcaataagctccagggcttcgacgaatacaccgccggcagcgccagtgagatcagcggcatcaaggttgtggatgatcatacattggagctgactctgacagaaccatatgcgccgtttgtttcaatgctgtcatcggccgctctagctgttgttccacaggaagctgtcgaggaattcggcgacgattttggacagcatgttgtagccgccggaccgtttaccgttggacagtggaattttaaccaggatctgacgatcaacgcgttcgaagattattgggcgggccgtccgtatcttgacagcgtcaagtttaaggtcattaatgatgaaaatacacgtattgtggaatttgacgcaggtacgcttgatattgcctggatcacgccggcgcattacgaccgcctgacaagcgatccgcgttatgcaaacagcattggccgcgccgacacgctgcacaccagctttttgatgttcaatatggaaaaggagccgttcgcgtcaaacaaggcgctgcgcgaggccgttttgtatgcgcttgatacgcaggctaccatcgacatgcttcaggggcgcgcctccgtagcgaacgtcctgcttcccagcggtatgctcggttccggcgatccggctaccacaccgccttatgatgtggaaaaggccaaggctaagatggcggaagccggttatgcggacggtctgccgcagaccttcgaagtcatcacacctgcatggaacaacaacatcaaaatactggagatctatcagcagaatctgaaggagatcggcatcaatattgaaatcaaggcactggagaattccgcctataacgaggcgcgcgattctggacagtttgaaatcgcctggggcaatattgtcgcgacatatcccgatccggacgccatgttctatccgctgcttcattccgacaatatcggagcggccggaaactacgcccgttactccaatccggaggttgatgcgctgatcgagcaggcccgcgcttctacggacgacaatgagcgggcgtcgctgtaccagcagatcgaacagttggtgctcgaggatctgccgtatgcatacctgacgcacaatatttacgtcgacatctgccagccgttcgtccgggattactgcccgagtgccctggatgtatcgacctatcaccgtgtctggcttgataagtaagagctgttggagcagtccggcattcccgcggaacagctttattccgcgggaatgccggatgaagaatgaaagggggtggctttgatgccccgctatattgtccgcagactgcttgccctgattcctgtcatacttgggttgacgctggttattttcctgctggtcaacgtcattcccggcgacacggccaggctgattgccggcgaatatgccgacgaggctacagtggagcaaatccgcaccacaatggggcttgacaagccgatcctggtacagtatggaaattaccttctggaccttgtgcagggagatttgggacggtcctatcagacgcatcgtcctgtgctggaggaaatactgaccgtctttccaaaaacaattcaactggctgtcacgacagaagtgatcagcatcgttgtcggcttgtttttaggaatgagcgcggctgtgcgccgcggcagcctgttcgatcgaggcatcacaatgtttggggtactgggactttcaatcccgcagttttggttcgcactgattttacagcttgttttagctgtaaaattcggttggctcccaccttctggctatcagggcgggtttgatatctatatcatccttccggctatcaccctgggcattccgtccgccggaatgatggcccgcatttcccgatcagcgtttttggaggtgctgcctcagaactatatccgcacagcgcgtgccaaaggtctgcgggaaaaaagcgtcatctggaaacatgcgctgaagaatgcgttaatcccggtgctgtcgcttgtcggtacggatatgagccgtctgttgaccggtacaatgatcgtggagagcgttttttcctggccgggaattggaaagtatgggtatgacgcattgttttataaggacatgccggccttacaggcaaccgtactcgtccttgccgtgagcatctgtctggtcaatctggcggtcgacgttctgtatgctgccgcagatccacgcgtcagatatcattaaggtatcataaccgtaaagcggttatgataccggagtttcccatagttaaagataccacaccaaacataacaacaccacgcttatacgggacttagcacaccccaaaagaacatacagaaatcccccataagcaacaaggtttgctttatgggggatttcttgttttaattgtcgtttttgatattattcaacagtctcaatagaatccacaatgctcattcttgcaatagaacgcagaggaattgccgttgcaagcaggcaggccacaatagaaataatcgcagcttccacaatcgccataaccggaacagcgacaagctgtaaagcatcggtctgtgctgctccgacaaagatacagcagacatagccaaacactgctccaatcactgacgcaatgataccgtaataagcgccctcccacagaaatgttttataaaggcttgcggcactcattccaatagcccgctgcatcccgatttcaccgacacgagtatgaatattgctgtaaacggtattgatgatgttcaggatgccaatgataccgataaagatgataagcacccagcacagcattttgatctgttcaaagctttctatcatctcattgctgctttggagataggaaagccaatgtgttcctggataattgctgcaccagctatccaaccagctttcaaaggtatctgtatcggcgttatcctgtaatgtaggatagacttctgaataactgtcgtttccgagcagtgaacagtatatttcgtcattcacgatgagttgaacaccattcgtaaagccatcattattgattgtgattgctgtatcgatcaatcctaatacaggaagtgttctgtctcccagttgaatggtatcacctacggtaagatcagtctgctgaacagttgtatctccataagaaaaggcaatgggattttttacaaggcagcctgttccatctttcaaagcctgtttatcctgagcagacaagttaggagcatagatttgtaattgtgcttcatccacatttacaagctgcaaggtttcatggctctgtacggaaagatcagtttcaaagggcagtatatcaccggcacctggcataaatacagaaagccgtgtagtggaaacactttctactgcgtcattttccgctaatgtttttacggcttctgatgggatgccaacggtttcatttgtaactgcatagtcgctgaaatacatgtcctgaacggaactgctggcatcaagcagccctgtaaagctctgcaaggcaacaaatacggtaatactcataaccaaagacagaatggtaactgctgttcttccacgccctcgttttaggttgagccttgcataataggcttcaaaattacggatgttgcggttcctttttatcctgcgtttgattttcacagtctgccccgacatagcaacagtaggagatacatgggatgcgtaccgggcagcaggaaaggcagccagcagagcaaacagaagtatgactgcgatactggcaaagagcatcggtagttttaccgtactggcggtgttgattgcagagttcaattcggaagtgctgtttgccatgaacagatcgggattgagaagccccgtagccgcaatcaatacaccttttgccgacaatataccgagcagcaatccgataggaataccggctccacagagaatcaaaagctgcaaagaaaccaaacgatagatttgccctcgttctccaccaatcgcacgaagtgttccgtattctttgatgcgttttgtgatagagattttcagaatgttgtagattaccagcccagccgccagcaagaccagaacacccaccaaaatacacgccgcagtcataaatgaaaatcccgtaccggtatcgctgtctgccgcttcatcataggaaataccaatagcgtcaagcaaaacccagttatattggatataccgttcatccacgttcaaatcttctgcgagagcataaatgatgctttgaaaattttgcttgtcataagtcttaaaatctgtggaataaagcagatactcttctggcaacagttcttctgcggttccctcaccgacaatccccacaaccgtaccagatgcgtagccgatatagctgctttccagaatgcccgtcaatacaaaatcagcagaatattctaactctgacagcgatccatccataacggaaacactcaaatccagagaaacggtatcgccaattacagcgtccaatccaagatattgaagcgcatcctccgacagggcaatctcaatcgcttcctctggtaatcgtccctcttttacgtttccgattgccgggtacatagataatgcgttatcgtgatattcccgaagatataaagataaactactgttgcctaatggtgtgctgccgataaagatcgtatcgcctacatcatataggcgatcatcttcatgcagcttttgcgcttgttccttgccaagctgatgaaaggttgcataacggtttccgttcagacccgccgcctgctgaatacgcatggattgcaatataccaatagactgaccgatcactgtcgtcataatcgtggacatgataactgcaaccaagatcaggattgccgtgattttctgtgctttcagttctttccatgcaagagctaaataagatttcatcttgctgtcacctccgaaagaacaccgtccacaattacaaattgccggtctgccattcttgcaatgcggctgtcgtgagtgatgataacaagcgttttccccatctttttccatatgctttgcagcatttccataacctcgccgccgctcttgctgtccagatttccagtcggttcgtcagcaaaaataatatccggctttgcgatcagggcgcgggcaatcgctacacgctgttgctgaccgccggaaagttcatggggcaaatgggtcagccgttcacgaatacctaacaaatccgtaagctgatttagatatacttcgtccggctgctttttgtccagaagcaggggcatgatgatgttttcttttgcggtcagcacagggagaagattgaattgctgaaagataaatccgatgcgccgacggcgaaatgaggacagttctttgtcattaaaacgataaatgtcttttccatcgtatgtcagactgccggaagtcggcttgtccagtccagacagcaggtggagcaaggtacttttgccgctgccagatggtcccataatagaaataaaatcgctggatgcaatttcaaggttgactttatccaacgcaacgacacggctctcgccgctgccgtagattttcgatagttcctttgcttcaatgttcataaaaaacactctccttgtttataatataaggagagtgtaaaacagaaatctcaaaaaacgctcaaggtttctgatttatttggaaagaagcagtagccgttgcgccataacttttgctgttttccagtgtaagtgttcctccatgcttcagacatagtatctggctgctgtatagccccataccaaagtgtgcggagtcttctttcatttttccaaacggtttcgggccgctttgtattaactccacaggatagcctggcccatcgtctgtaactgatagatgcaagaagtttcctttccgttccaaatgaatttcaattttactctttgcaaaccgagccgcatttccaattagattttcagcaacggttaaaaccaatccatgatctaattgtattgtccccttatcaggtgcggaaacagacggttctaatgctcctgcaagaatttttgctgtttcctctaattcagaatgtagcagtgaataggaatactcgtttatccgcaccggcatttgttctaatcgttggatgctactcatagcttctgcatactgttcaatccgtaatgtatagctttccaatctgtcaatggcttgttcatctgctgttccctgccgcagtaattttatagttccctttaagaccgtgatcggattgcgcaagtcatgggaaaaggcggcatttagccttttccgttcttctgcctgccgccacagttcctgatttgatttcagaagttcttcgcgcatagtatcaaaggcggtgcagagctgccccaattcatcatcagaatggacaggcatagaaaagtcaaggtcatggttccgaatccgtgaaatcccattccgtagcgtggagatcggctgtttcaatttgatatgataatataatatgccggatagagccagcccgcccatagggagaacaatgcaggacacaatttgaatgattccaagcatggacaatatattttgctgggtctctgtgggggtttccattttaacgattgaaccgtctgctaaaatttctattccaccggagggaaagttgctgctgattgaattgcatatcataaagactaagcctaacatcaggagagccaccaaaacacaggaagcagataggacgagaaaagttttctttaattccatatttttcagacgttccaccgataaccacacccccaaactgtatcaatataactgtgaagcgtacaagcagccagcttcgcccggattttcctgatatgttccatgacagtatcactgttaccctcgccgtcaagtccccacactgtttcataaatacgctcccggtcaaatacctgtccggcattcagcgaaagcagctccacaatatcaaattccctttttgataaagcaacaggttcacccgccactgtgacggttcgggctgaataatcaatcgtcagttcaccaaagaagcgaattgtcgctttattcctgtgtcgctgctccctcctcagatgtgcggcaactctcgcccctaattcgtccaaatcaaaaggcttaatgatataatcgtcggcacctgcctgaaagccgatgattttatcggcagattcgacccttgccgtcaaaaaaagaatggggcaagtaataagctcccgaattttctgacaaagggtcaatccgtctatgtccggcatattgatgtcgagcaggattaaatcgggctgtcttgctaatttttgaagtgcttcatttccgcaataagcggtcaacacctcatattgagaagaaaaataactcgccatcatatctacaattcccggttcatcatcaacaataagaagcctttgtttcatgctatcatctccatttgcaattcataatatttatcgtaacagccaaatctcaaaaaacgctcaaacttttgccgtcaggaaagtataaaatcaatagactgataaatttattataatattactctgctgatacagccagtccgtaaattctttcgggctggctgtcttttcttttacagccttttttctcttcaatgcttctttcttgaacgcttcaaaagcagtcagcatttcttccagctggtcagccgggaatcccgctgtcctcttcgctttgttgatcttattgcgccagttctggcattcatttttataaagcaggtcatagttattttctcttgccctctcgtcaaattcccgcttgttttgaagcgcctgtgcttttcggcaattgtcgctgcacagctcataccgctggctctttgccagaaaatattttccacaaaccttgcaccgccggaagcaaagcccccagtcattcagcctgttcagataataggtaatcaacgggtagagggacgcataggcagacacacattcttctgtgcgccggttgtccgggaaccagaggtcaagccgggtatcttctgacggtgcgcctttgaaataaaggctgccagcttgaaaatgtttcggttttcctgtctccctgtcaaagctcatggtttcgttatggaataccccggtcaggctgctcattttatccatgaagcggtcacaggcagcgttacggtcacggggttctctggcaagcagatagctgttccagatacggaacgccacatacattttcagagggtcgttgctaagatatttctcccaaagaaattcgcttgccgcctgctccagctccggctgttcccatcggttggagtggagggcttgccgcagcggagaaagcccgtataagttccagtctctgtccgtgtcacgctcaaagtttatcaaaaaagttcccagtgggcgtgtcatatcacaaagcacctctgcgttttggctcccgttcaaacggaagcggatctgctgttcttccccaatcaaaatccgttctttcattttcttcctgtccagcgtcaggacaaacaaaatcctctcaaaacatggctcatgccgtataaactgattctccatccctatcccctgcctttgtttatggtaattatataattcagttatatccgttacactcatggtatcgcagaatcattgttttgtcaaggatagtacgctatgatgattgcggttggtaatttcgtaccgcacagtaccttgacaagtgaatgaccgtccaaaagggatatgaccggcaggagaagtgacgcattcggcgcaccaatgcagggaaacaccgcaggaatggggcaggaaaacggcttttggggagaacggcaacaggaagcattttaacctatttgatttatgggaggaacagaatgaacgataaaaagagattgaacagctacgaggatttaccgctggttctggatgtggcggacattcagcggattatgggaatttcaagagcgagcgcctatgagctggtacacacacccggctttccagcgttccgcaggggcagacttatcaaggtcagcaaaattgctttctttgaatggatggcaaaaggctccgaaaccgtaccgggaagcgacaaataagcgtgaggtatcattccctgacttgcaatactgccgcactttccaaaggggcatacagagggaaaaaaacttaaaaatgataccgagacgctacatcaaaacagcctatctgcgtacatcagatagaaacggagaaaggagccggttatggcaagaatgagtaacaagcggcggttggaatggtctttcttcttaaatgaccgcagccgtatcacttacaacgaactgtgccggaaatgccagcacgaatgtaaacagagcttccgggcggttgtggttgactgcccgaagtatctttccaagcgttccaagaaaaaggacaagactgccggaaacggcaaaatcccttaggaactaagggcgcacttctatacatagtctaaagaccatgtatcgtgcgtcctgcggagcttacctctgccgctgataaaatcagcaatccgaggtctgcgttcgctttgctccgacaaggtggctacacccccttgcgccgctaaagcggctatcccctgtgtacccgccgcaaagagaaatccgctttgcggttttcccttttcatcgggttttatagaagcactgacacacggactgtctgcggatggtctttctttatcttatcagcaaaggatgtgagaacatggaaaaatctttggaacagttgaagcaggaatatgaaaaaaccactgtcctgctggaacgggaaaaacggaaaatgcagcgtttgaaaaaccggcaggcgtatctggaaagcggttcccggaaacagaggacgcaccggctaattacccgtggggcagccgttgagagcattgcgccacagacaaaggagctatccgaagcggaattttattccctcatggaaaacattttgaatctgccgcaggcggagcatttcatccggtctgccactgagaaccacgcccgtatttccgggcaggagaaaggcggtgactaaggatagcactttatcatttttcaatcgcacagataaagcgtagcgccggtcagagcgccattgcaagcgcagcctaccgatccggggagcgtctttacagcagctactatggagaagtcagcgattacaccaaaaagggcggcgtgattgcttcggaaatcatgctgccgccccatgcgccggaaatatatcttgaccgggcgaccctctggaatgctgtggagagctgcgagaaacatccaaaagcacagcttgcctattcctttgatattgccatgcagaatgaattgacgctggaagaaaacatggagctggcaaggaagttcgtgcaggagcagtttgtggcaaaaggcatgattgccgatcttgcttttcacaacccggagaaagaggacggcggcatccctaacccgcatttccatgtgatgacaacaatgcgccctttgaacccggatggcacatggggacaaaaacagcggcgggaatatcttcttgatgaagatggaaaccgaatccgggataaaaatggcgattatatgtttaatgctgtccacacaacagactggcacgagccggaaacactggaacactggcgggagcagtgggcggctgccgttaatacaaaatttgaggaaaaaggactggatgtgcgtatcgaccaccgttcctatgtgcggcaggggcttgacctgatacctactgtccacgagggagctaatgtccggcagatggaagcaaagggcatccgcaccgagaaaggggaactgaaccgctggattaaagccaccaaccggctcatgcaggatgtgaggaagaagatcaaagccctgtttgtctggatggcagaggtaaaagaagaactttccaaaccacagacaccgaaccttgccgacctgctgatcgcttattacaaccagcgcaacgcaggggcatggagcaataaagccagaaccggaaacttaaagcagtttgccgaagccgtcaattatctgacggaaaacaagctgctcacattagaggatttgcaggagcgtctttcctctgtcagtgaagaatttgaagcattaagcggctccatgaaaaagaaatctgcccggataaaggaattgcaggaattgatacgggagggcgagaattaccagcggctaaaacctattcatacggaattgaacaatatcaagtttaagaaacagagggagaaatttgaaacatcccacgatgcggagttacggctgttttatgccgcccgccgtattctgaaagaaaaactggacggaaaacccattgccctgaaagcatggaaacaggaatacgcacagttaaaaacagagtatgccgaactgtctccgcagcacaagccgctccgggaggaagtcatacggctgcggcaggtgcagaacgccgtagataccgcactgcgccggagggagcagccacaggaagtacagagaaagaaacacgagatggaattatgatataatcggcagctttaccgctgccggcatttttatggagggagcatttgaatgtatttgaagcggtgaaacagtctgttaccacccggcaggctgcttcattctatggaatccgggtggggagaaacggcatggtctgctgtccattccacaatgaccgcacgcccagcatgaaagtggacagccgcttttactgcttcggctgcggggcttccggggatgtgatcgacttttccgctttgctgcatggattggggaaacgggaagctgcggtcaggcttgcggaggacttcggcgtttcctatgagaaatccggcaatgcgccgccagataggaagcgtcacaacaggtcacagccccgacaaaaatcagcggagcagagatttcaggaaacggaacggtattgtttccgggtgctatgcgattatctgcgcctgttggagcattggaaaacagcatacgccccacagccgcaggatgccatctggcatcctctttttgtggaagcgttgcagaggataagctacacagaataccttttggatattttgttatacggagaaatagaagaaaaagcggcgttgatcgccgcacagggaaaggaggtgctgcggcttgaacagcgaatttcagagattgccgctggaaacgcaggaagcggtcaaaaagacgatggacacaatggaaccggcgcagacaccagcagaaatccgggagacattagaggggacgcagaaaggcggcgtgaagaacagcatccgaaactgcctgacggtgttccagcgtgacccgctgtttcgtggggcgctgcgcctgaaccttttgacggagcagattgacattgtgaagccgctgggctgggagcgcaccagtaccacgctgaccgacatggacatgaactacctgcttttgtatctggaagaaaattacgggcttaccagcgagaaaaaggtgcagagcgccatcaagattgttgccaatgaaaaccgctaccatccggtcagggattacctgaacagcctgcaatgggacggcacagagcgcatccgttacgccctgcatcactttctgggagccgatacggacgaatacacctatgaagccttgaaactgttcctgataggagccatccggcgggtattcagaccggggagcaagtttgaggtcatgctctgtctggttggtggtcagggagccgggaaatctacctttttccggctgctggcaggtagggacgaatggttttcagacgatttgaagaagctggacgatgaaaatgtgtaccgcaagctgcaagggcattggattatcgagatgtcggagatgattgccacagccaacgccaagagtattgaggaaatcaagtcattcttaagccgccagaaagaaacctacaaagtgccgtatgagacacacccggcagaccggctgcggcaatgtgtattcggagggacgaccaaccggcaggactttttaccccgtgaccgcaccggcaaccggcgctttctccccgtgacggtgtacccggaacgggcggaggttcacatactggacgatgaagcggcggcgagggcgtatatcgaacagatgtgggcggaagccatgacgatttatcgcagtgggaagtataagctgtcattcagcatagaaatgaaccgatacctgaacgcccatcagcaggacttcatgcaggaggacacacaggctggcatgatctacgcctatttggaggactacaccggtgacagggtatgctccaagcagctttatgaggaagcgctggggaacttaaattccccggcagactgggagacacgggcaatctgcgagattatgaataccggcattgcgggcggcattatacagggctgggcagcctacaaaagcccgaagcggtataagaaatacggttctcaaaaaggctgggagcgtgtcaaccaagacccgccggagggggacggttttcaggaaatcacggaagaagaagcccggcaaatggaactaccattctgaaaagccaccggttaacagtttggttgacgcttcggttgacagccggttgacggggaaaagcctgatatttggggcatttctctcctttgtcaaccatgtcaaccaagaaatcaaagaaaaagtaaaaagtaataatagagcgcctgtggattgttttcaaagtcttttctgccggttgacacggtttggttgacatgaagacagtctgcggctgtaaacctgcctgacattcccttgtcgggcatatttcatttatggaggtaactgcctatggcaaaaagcaaaaacgagagcaataacaaaaacagcggcaccctgcttaccgaaaaagacggcacccagtattttgtcatggggaaagtccgtatcaaggtatcggagcatttcgcacaggatgggaagccgcttgacagtctgctggaagatgtgatccagcacgctgccgccgcttcctgaaaaaatacggaataacgactgtcaatcagcccacgcttatgatatacttgtaccagcgagtattgtataagcgtgggttgtttcttttagaaggaggatttttaaccgtgaaacaaccatacaatacaacgatttataacactgcactatatttgagattgagccgtgacgatgaattacagggggaaagcggcagtatccagacccagcgcatgatgcttaggcagtatgccgcagagcatgggctgaccgttgtagacgagtacattgacgacggatggagcgggacaaatttcgagcgtccaagcttccaaaggatgattgatgacatcgaggacgggaaaatcaactgcgttgtcacaaaggacttatcccgtctgggaagaaactatatcctgaccggtcagtacacggaaatctatttccccagcaagggagtacgctacattgccatcaatgataatgtggacaccatcaacggagaaagcgagcttgccccgttcttaaacatcctgaatgaaatgcacgcccgacagaccagcaaaaaggtcaaggctgccatgcacacaagatttgccaatggcgcacactatggagcctatgcaccgctgggctatgtaaaagacccggacaaaaaaggtcatcttctgatcgacccggaaacacgctggattgtagagaagatttttgatcttgccgtacacgggaggggagccgccagcattacacggattctggtggaggagaaagtacctacccccggctggctgaactatgaaagatacgggactttcgccaatatctacgccggtgcgcctccagaaaaagcctatgcgtggacgattgcacaggtcaagagcattttgaaagaggaaacctacatcggtcacagcgttcacaacaagcaaagcaacatttcattcaagaacaagaaaaaggtgcggaagccgcaggaagaatggtatcgtgtggaaaatacccacgaagccatcatttccgaagaagtgttccaaaaagttcaggagctgattgcaagcagacgcagacgacagaagaatggcacaacgcagatattttccgggctggtaaaatgtgcggactgcggatggtcattggcttatggtgtaaacagccagaacaaaaatccctatgcacactaccattgcagtaagtacggacagggattacgccagtgttccatgcactatatccgctatgatgtgctgtatgcctatgtgcttgcaagactgcaatactggtctatgctggcacagaaagacgaggacaagctgctgaaacggctgctcaatgccagcgacagagaaagaaactctgcgaagaaaaagcaggctgcggagctgaaaaaggcggaaaagcgtaaagccgaggttgacgggctgtttgctaaaatgtatgaggactggtctgccggacgcataaccgagtataacttcaatatgctgtccgagaagtaccagaacgagcaaagggagcttgaaacaaaaataaggcagcttcacgaaacgatggaagccgccgtacagaccgcagcggacgctgaaaagtggattgccctgatgaaacagtatgtcaaccctgtggagctgaccgccgaacttctgaacactctaattgaaaaaataaccgtccacgaagctgtcaagggcgaggacggaagtcgtgagcaggaagtagaaatctactaccgcttcatcggcaaaatcgactgacctttcttttttacccaacaatatctttaattaagggaaacgggggttatacccaacggatcgccgcttacgcggcaaccaccttttgatgggcaattataccatagtccaaaccggcaaggccggttttgctgccgctttgcggcagacaagcccaaaggggcttgccgctgtggcataattgaaaccacttttatctttatgccgatgcgaagcggcggattggatggtcttttatggaacagaaccgataccttcctaaaaataaaaaataccgtcggatgctggaatcgggtgcgccgccgtcgggaagcctgtatcgggatgcctggcaggcgctcaaaaaggatcgcgccgcaatgatcgggcttgtggttatcgtggcgctggccgcgctttcgatcctgctgccgatgattctcggcctcgatccggaggccatcgagtcgcgcagggtggtcgatgggaaaaatctgtttccgccatttgcgcctgatcttgcgaacataatgggtacagaccagcttggccgcgatatctttacccgcgtgctgtatggaatccgtgtttctctgttggtaggcgttgtcgcacgcgggcttaccatgattgttggaattgtactcggcgttgcggcagcctattttggcggatgggtcgacatggtcattatgcgcctgaccgatatttttctcgcttttccagtgatgctgttggcgatggtgatcacactcgtcatggggccgagcctgtttactgtttgtcttgcgctcgtcgtcgtcggctggccggatgtcacacggcttttgcgggggcaggcattggcgcttaaggagaaggagtatgttaaggcgtcgcgtgcgcttggcgcgtcgcatttctggatcatcacgcgtcagcttttgcctgggtgcctgtctctgattatcgtatccttttcaatgggaattccaggcgcgattatgtacgaatccggactgagcttttttggattcggtattcgtccgccaactccttcactgggaaatatgatcgccgatgcgcgcggttatatgaccatttgtccgtggtacattctgtatccgggcctgatgctgattattattgtagtcgcatttaatattctgggcgacgggctgaatgatgcgcttgacccgtacgccagaaaacggaagtaaaatatgagtcaatcaacaattcattccacgctctcatttgagcatccctgcttttccaatcatggagcgcgtgtggcgcgtatgcatttggctgtcgcaccatactgcaatataaaatgtgcgttttgccgtcctacagtcaatccgtgtatacacggatgcgctcctggactagccaacgagattctgacgccgcagcaggctttggagcaccttcgcagggttcgtgagagcgggatcgatatccgcattgtcggaattgcaggtccgggggagccgttggcaaatcctgaaacctttgagacgctgcgccttataaaagcagaatacccgcaaatacatctctgtctaagtacaaatggtctgttccttccggagcaggcaagccggctggcgcagcttggtgttgagacgctgactgtaacagtcaatgcccatacgccgaatgtggctgtacatatttatgagcatgtatcgggcgagcggggagagaacgctgtacggcgccttttggagcgtcagaggacaggcgtcaaagaggctgtcaaggctggcatggttgttaaaatcaattcggtctatgttccgggtattaacgacgatgacattttgcagatttcccgggaaatgcgtgcgataggcgccacgcttcagaatattctgccggtgatcgcgcgcgatacaatggcaaaggttactccgccggacgcggagcagttggaacagatgcgggagaggtgcggcgtcaatctggaacagtttgtgcgctgcaagcattgccgcgcagatgcaattgtggacgcggaaccgtcctgtgcgggaaaatgagaaacagggagttgtggaagcattgttcaatctgttcccggattattttgcgaaggatgtaacctgtattgacggcagcctcctggaccggttgaatattcaggccgtcatcacagatatcgacaatacgctggccttggtagacgcgccggatcctgagcctcaggcgcgggaatggttggattttttaaaccggtacggctgtcagactgcgatgatttccaataacgacccgccgcgtgtgaaggcgtttgcaaagctgttcgacgcgccctatgccgcccatgcgcaaaagcctgcatccggcgcttttctggagctggctcgtcggctcggtgtcgaaccggaacgatgtatggtggttggagaccagatgtttaccgacattatgggcggaaatcgtgctgggatgcatacggttctggtggaacctttgggcagcgaattggatcacgcacagtttcggattaggcgatgggccgaaaagctgttgctggctgtttacaagcgtgtgacgcacggccgcagcctgtcggggcaaaatccgtccggcgcagatgtgacgctttgaaatggaattttaaaatttttgttttgatgcagtgcaaataaagataaaaaattccccgttaagagggtattgcgataagaaaatatcctgtaggggcgcatactatgcgcttgtgggcggctgacagccgcctctgtggggattcttacagcaatgattttaagctgtgtgctttttattgcacttgagaaccttcggcttgtgtcagggggttcagaaagaacctataaaaaattggacatccgtgccggtaactgcacggatgtccaattttttataggttatagtaaagcgtgtaatcggtgtgtttatgcttttaaactctccaccgcctggcgttccactgccagaccgcagcgatactgcctcatgaactggttgaaaccctccacatcctgctgacggggttccaaggtaactacggtctggccggcaaaaatctggttgtcaaggtaatcctccagtgattgtccggattttttctctaccagataggctgccagcagggccataccccagggaccgccttcgccggcagtttccatgacagaaacgcaggttgcggtggcggcagccaggatacgctggccgacttccggagtcttaaagaagccgccgtggcccatcagccgatggacagctacatgctcctcagacagaagatccatcccgatcttcagcgtagccagggcggagtagaggtgggctctcatgaagttgggaaagtcaaattgggaccaaggagtgcgtaccaatagagggcggccctccattaatccgctgattggttcaccggacaggtaattataaagagtcagcccgccggcatcctccctaccagccagagcggagtgaaacatagcggagaaaacagtatccatgtcagggacctgccccaaagcctccaggaatcccttaaatacctgtgcccaggcattgatctcattggtacagttgttgcaatgaaccatggctactggctgtccagatggggtggtgaccatatcaatctcagaatagaccttggacaagggcttctccagcacgatcatagcaaacacactggtacctgcggacacattgccggtgcagggaacgacagtgttggtagcaaccatgccagtacccgcgtctccttcagggggagccagaggaacgccaggggacaaaaggccggcagggtccaaaagtttagctccctctggggtgagggttccggcgggctggccggcgtggagaacctgcggcagaatctcccgtattttccatggatagtgcttctcagccaccagggcgtcgaaggcgtctgccattgtctgatcatagtccccggtgcggctatcgatagggaacatgccgctggcctccccgactccgattgcctgacagccggtgagcctgtagtggacgtatcccgccagggtggtaagacagcggatatccttgacatgttcctcatcattgaggatggcttgatagaggtgggcgatagaccatcgttgaggaatgttgaactggaaacgctccgttaaaatcctggcggcctgtccggtgatggtgttgcgccaggtgcggaaggggactagcagttctccgtttttatccaaggccatgtagccgtgcatcatagcggagaagcccatagcggctatggaagtaagttccacgccgtattgggtgaatacattgccgcgcagcttggcgtaagccttttggagtcctgtccatacatcttccatgcggtaggaccatataccatcctccaaccgattctcccaactgtgctcgcccgaggctaggggggagtgatcagagccaatgagcacggctttgatgcgggtagaacctaactcgatacccaagcagcagcggccttgggcgatatcttttgctttattcatagggagaggcctcctttagatgtttttcccatagattgctgaataaactaaggtaaattggctttccgcgccgcaggcggcgcggggccgtttgattaaatacgtctgtccgcggaacgggcagatgcgcaaaaaacagttgttttacaaccgttttttatttttctgcgatgttgcgtacactgctgcgttccttcagactgggggagtagacgatgcggaaacggcggccgagcaggttatcctgccgctgtaaaaagacatcggcggcggagagtcccatggccaccgggtcacaactgatagtggtcaggtccagcccttcctcgtctaccagatcagagtcatcaaagcacaaaatgctgtaatcctcgggcactcgccgtcccgcgtcccgcagacggcgcaccattcctgcggccatatagtcgttgcccacaaatacagcggtgcagggtttttcttgagccaacagccagtcggcaaattttcgtccgctctcccgggtgttgtcaccgtataccatatccaagctggaaaaggacaggccatagttttgcagcccctccgagaaaccccggcagcggtcagatgcggtcccggaaccctttactccagtgagcatagctatatggcggtgcccccgctcccagagatactgcgctgccatatagcctccccgatagttgtcgatacgcaccgtatccagatccagggcggagatatagcggttgaccagtacaatgggaatagatgagctttgcagcaattgtatgatttcctctgttgcggtcacagtaatcataatgatgccggaatagccgttttccatggcgcggcgcatggctgccagctcccggttggcatccaaaccacagtggcacagtacaaccgtataccccaaagggtccagcccctcacagatgcctttaaccaccttggaataaaagtaattcgaaatgtcgctgacaatgacaagcaccgctttggacacaaagccctttcccaacaacatatcatctccgtcggtaatcccaagctcctgcatagcgttgcggatcttctgcatggtttgcggctttaccttggcgctattggtaaaggcacgggaaacggtagcgtaggacacccctgcccgttcagcaatggtcttttgtagaatgatcatggcaattctgctccccacctgtattttacttttctatcataagatttccctttcaaaaaagcaaggttattttcatgaaatttctgaaattaatgaaattagatagacggtttttggggaatatgatatattcatgatgtcatcgcggtggaattttgttgaattatgaggatattgtccaaaatattctcacttcactctatggtgtgaaatgattcccatgcgaagaatcgcaccacccacatatcctgtcgttacagatgaaaaggaggaactcaaatatgaagtggaatcgaattttagcgttgggtatgggcacggctctttgcctgtctctgatggccggctgcggctccggaggcgatatttccagcagtgatgtgcaggaggatggatttcctgaattgaacatctcgctggctcactccgccgccaccagtcacgcgcataataccgctgctcagacgtttgccgatattgtttcggaacagaccggcgggaaggtcacagtcaccatctatcccgccagcgaactgggggaccagcccgctctcatcgagagctgttataccgatggcgatgtggatatggtcatcgcctcccaaagcaatatggccacctatatgccaaaactcaatgccttggccgctccattcctctttgacagctacgaccatgcacataaggtcatggacgattatgtgctggactggattaatgaggatgtgggaacgcagatgaatatgcatgccctggctatgtttgactacggtttccgccatgtcacgaccaacgacatcgtggtcaactccgctgatgatttaaacggcgtcaagatccgggtccccggatccgccgggcttctggccacctttgacgcgcttggatgcaacacacagaccatcgcctattccgaactgtaccagtccttaaagcagggggtcgtagcggctgaggagaaccctgtggccaccatcctagcagactcctattttgagtgtcaaaaccaactggctctcaccggtcatttctttgatgtgcaaaccctgctgataaacaagtcgctgtgggagtctatgagtcccgagcttcagcagatcattcagaatgccgctcttgaggcgcagcaggtcacccggaacctcatcgctgatggtgaggatgcggacatagaggcactgaaagataagggaatgaacgtaaccacaccggataagcagtcctttatagataaaatggcaccggcctatgaagaaatagcctccctgtgcggtcaggatgagctggataacctgatggctgccgcaaaggccgcttcagagagcgcctgaatcacagttagaaggcccccagcgctatttgccgccgaccgcggcatctttacggctgaaaggagagtgagattacccccatgattatgtttgttatgtttattgcggtactggcggtgctgttcattggcgtatccaccgcgtgcagtatggccttggtttccgtaggagcttatttttctctgggagaggccacgatgtccaacatgatgtctttgccgcaggggatgtttaaccaggtcagcggcataactttgatgtccattccatttttcctgctcatgggcaattttatgaatgccggcggtatttcccaagacctgtttggctttgcccgtgcctgcctgggccatcgctggggcggtctggctaacgctgcaattgtctcctgcatggtcatgtccgcgatgtctggctcggccgccgcggtggctgccggtatcggcatgatcgctatttctgagatgcgcaagacaggatacgaacagtccttttcctgcgcgactatcgctgcatcgggcggtctgggacccatcattcctcccagcatcaccatgatcctgtttgccagtatgatttcggaccccaaggtgggggtttcagtcaacgatttgtttatgggcggagccatccccggagtgcttatcggcatcatgtttatcacctatgccagtttcgcctgcaaaaagcgaaattttggtaaagtacctcccatcccgatgaaagaacgtctgcgttacttcggcaaggccatttgggcgctttttactccagtgatcgtgctgggcggcatgttcggcggcttgtttaccgctacagaagctgccgcggtagcagctctgtacgctgccctattggggatattcaagtatcgcaagattaagctgaaggatttcccccatatcttttggattaccgccaaatcctccgcacaaattatgttcgtcattgccaccgcttcttttttccagtacgtcctgctgcgtacccgcattccccagcaagcggtaaatgcgattgtcagcgtttttggcagcatagttccggtcctgcttattattattttgatgctggttattatgggctgttttatggagggaaccgctattctaatgatcactgtccccattttcgtccctctggcccaagcttataactacagtatcattcaactggccgtggtgatgtgtatatctctgtctgtaggcgtgattactcctcctgtgggcctgaacttatatgtgttgtccagcattactggggaaaaggttatgcgaattgccaaagaagcagtcccctttgtacttattatgattacggtggccctgctggccgcttttatcagcccgttatccctgttcctgcccggtttgggttctgtgtaaggaggattcccccatgaagtactggaataaatttgagaacattgtgggcgtcctgatgcggagcattgcctctgtctgcctggggattgtgtttgccctgtttatcctcaacattgctacgcgtttaccatttatcacctataaccccaagtggattgatgaaacgatccaattttttctggtctggatgattttcctggggtcggcggagcttgttcgtaccagaggccattttgtggtggatattctcactgaccactttcacggtaccgctacagggcgggtgctggcggtaatctccaccgccctgatgctggtgacctatgccgtaattttctattttggcgtgcgcctttgcatgaaatctgacgccgcgatgtacactctgcactttatgaagaaaagctacttttactcctgtatccctgtttccgccttctttatggcgctctttaccatgcgtgatctgattctcagcgtcatggatattgttacccacggcgcggtcactcgccggttggatgcagaaaaggctgaagctatgaagcaggatgatgatgctaaggccattgctgaagcggctcaggccctgaaacaagatcaggatccccaaaagtaagccatggtgcgggatatcgcaccgtcacatgaattatgaaaaaggaaacggttatattatgaaacttgatcacattcgtgaaaaaatggaatccgggcagttgtgtttcggcacccactgttccactactgaaccttggtattatgaaatgtgtggttttttaggttatgattatgtatggattgacaacgagcatgcgggcatgaccatgccaatggtgcaaaacgctatcgtggctaccaacgccggcggctgcgccgcttttgtccgggtacagaaccacgacatttccaatgtcaagcctgtgctggaggtagggacggatggtatcattttccctatggtaaatacgccccaggaggcggaacactgtgtttctgtatgtacttatccgcttcggggagtaagggggtttggacctctgcgcgccatccaatacggcaatatgcccttggagaaatatctggctcaggccgaccgcagcgtgttgaagctgctccagtgtgaacacgtagacggcgttaaccgtttggatgagatcttggaggttcccggggtggacggcatcatctgcggtcccatggacttatccgcttccatcggtaagatgggacagcttaccgaccctgaagtggtagggctgatgcagaagatcattgatacctgcaaggcccaccacattccgtttggcatatccatcggcgtcaattatgatttgataaagttttggattgatcagggcgcgacctttgcctctatgggaactccggccgattatttctggtgtatgagccaacaggcagtggcaaaggcacggacgttcgaggcccagcgcagccattcagggatttcccagcttccgaacaaataatttaaaaagctgataggagacacggcttttcgtgtctcctatctttttatcataccagatgtctgctgtttttaaacatccccatagcgcccacgactgggaggtggtgggcaaacggttcgcccgaattgagcgccgcggttattgcgggcgctaggcagatgtcttggatcaactgttgcgcagacgcgtgcgttgagacggtgcagccccatcaggtattctcatgaaacccgcacgatcgcgggcgttaaaccggaggatacctatctgatcgatgggggccggcgggagatcatcacccaaaggggaagctggccgctccgcgaagtgtcactggacggcgcctccatcaagcgcccgctggttcttaaaaaagttatccgcctattgcggttgttatggctgaaataggcggatttttgtttaagaaggcgccatgccgagaaaatcgaataagaggaagcaggaatgctcctttttggtttgcgggatatatgctcagatattgcaatacagcggtattgcttggagaggtcttgtgtagtataatattaatctgtgcagaaagcaaaatttaatccgggaaaatattttagtgaccattttcgtttttgaacaaaattaagaaatagatttgcaaattattccaggctgcattggggggatttctagtggataaatttaaactggtttcgccgtttaaaccgaccggagaccagccggaagcgatcgaggcgttaacccgcggaatcctcgcgggagcgcatgaacagacgcttttaggcgtcaccggttcaggcaaaaccttcacaatggccaacatcattgagagggtaaacaggcccactttgatactcgcccacaacaagactttggctgctcaattatgctcggaattccgtgaatttttccccgaaaatgcggtggaatactttgtcagctactatgactactaccagccggaggcgtacatcgcgcatacggacacatatattgaaaaggattccgcaattaacgacgagattgaaaagctgcgccattcggcgaccgccgcgcttggggagcggcgcgacgtgatcattgtagcgagcgtgtcatgtatctatacgctcggcgacccgatcgattataaaaatatggtcgtgtcgctgcggacagggatgcagaaggaccgcgacgaattgatcaagaagctggtggagcttcagtatgagcgaaacgacatcaactttgtgcgcaacaagttccgggtgcgcggcgacgttgttgaaatctttccggtttattcgggcgacacggcggtgcgggtcgaatttttcggagatgaaattgaccgcatcaccgagatcaacaccgtgaccggcgaagtaaagaacgtcgtgacgcacgctgcgatctatccggcctcgcattatatcgttccgccggagaaaatgcgcgtcgccatcgaggagatccggcgcgaagctgacgaacgcgtggcgtatttcaaggaaaacggcaagctgattgaggcgcagcgcattgccgagcggacaaactatgatattgaaatgatgcaggagattggtttctgcaaaggcatcgagaactattcccgcgttatttcaggacgcgcccccggcagtacgccgtatacgctgcttgactattttcccgaggatttcgtgctgttcgtcgatgaatcgcacgtcacactcccgcaggtgcgcgggatgtacggcggcgaccgctcccgcaagatcagcctgatcgattatgggttccggctgccgtcggcgctcgacaatcgcccgctcaatttcgatgaattttatgcaaaactgaaccagattgtatttgtcagcgcgacgccgggcgcatttgagcgcgaaaagagcacgcagattgtcgaacaggtcatccgcccgacggggctttgtgatcccgagatcgaggtgcggcctgtggaagggcagatcgacgacctgctctcggagatcaaccagcgcgcggccgccggtgaacgtgtgctaatcacgacgctgacaaagaagatggctgaggatttgaccacttatatggaaaacatgggcgtgcgcatccggtatatgcaccacgatattgatacaatcgaacgtatggagatcatacgcgatctgcgcctcggtgagttcgacgcgcttgtcggcatcaacctgctgcgcgaggggcttgatattccggaggtatcgcttgtcgccattttggacgcggacaaggagggatttctgcgcagcgaaacgtcgttggtgcagacgatcggccgcgcggcacgcaatgcgcagggaaaggttatcatgtacgcggacagcgtgacagagtcaatggagcgcgcgatttctgaaacgtaccgccgccgtgaaatccagcttgcttacaaccaggagcatgggattgtaccgcagacgattaaaaaggatgtgcgcgatatccttgaaatttccgcgcgcgacgaccgcgataccaggaaaaagcgtggaaagaagctgtcgcacaaggagcgcgaggcgctgattgcgaagctgacgctcgagatgaaaaatgccgcgaagattttggaatttgagcatgcggcatatctgagggataaaattcaaaagctgaaggcggaggatgaacgtccgggcaggctgccgaagtaaaggagacgaacagaaacatttatggcattggataaaattgtaatcaagggcgcgcgggagcacaatctgaaaaacatcgatctggagatcccgcgcgacaagctgattgtctttacgggactttcgggatcgggaaaaagctcgctcgcgttcgatacgatttatgcggacggccagcggcggtatgtcgaaagcctgtcgagctatgcgcgtcagtttttgggccagatggaaaagcccgacgttgattcgatcgagggcctgtcgccggccatttcaattgatcagaaaacaacatcgaagaatccgcgctcaacggttgggactgttacggagatttatgactatctgcgcttgctctatgcgcgtatcggtatcccgcattgtccggtctgcggccggccgattgagcagcagacggtcgatcagatggtagaccgcgtgatggagctgccagccggcacacgcgtacagattcttgcgccgacggttcgcgggcgcaagggagagcatgtccgggagtttgacgcggcgcgccgttcgggatatgtgcgcgcgcgtgtagatggtaacctgtatgatctgtctgaggagatcaagctcgaaaagaataaaaaacacacgattgaaatcgttgtcgaccgccttgtcatcaaggaggaggtgcggtcacgcctggccgattcgctggaaacggcgatcagtctgacaggcgggatcgccgttgtcgatgcggacggggaggagctgaccttttcttcaaattacgcatgtcccgaccatgatatcagcatcgaggagctgaacccgcgtatgttctccttcaacgccccctacggcgcgtgtgataaatgcaccggcctggggacgtttctcaagatcgatccggatctggtgatccccaataagcgtctttccatccgggaaggcgcgatccgcgcgtccggctggtattatgccgaaggcggcatcgctcagatgtattacgagggcctggccgagcactacggtttttcgcttgacgagccggtttccaagctgcctaaacaggctgtccagattttgctttacggtacgaacggtgaaaaaatcaagatgcatcgtgacggcggaagtgtaaagggaacttactacacggattttgagggaatcgtcaataatttggagcgccgctttcgggagacaaattcaagctggatgcgcgaggagctttcaacatggatgagcagcgtcgaatgccctgtctgccatggcgacaggctgaacaagacggtgctggccgtaaccgtgggcgggctgaacatcagtgaattttgcaaaaaatcggtggccggcgcgcttgaatttcttgatgggcttgagctgacgccgcgcgagcggatgatttcagagctgattatcaaggaaatccgtgagcggctcggctttttgcgcagcgttggtttggaatatctgacgctggcgcgtgcagccgggacgctttcgggcggggagagccagcgcatccgtctggcaacgcagatcggctcgtcgctgatgggcgttttatatattttggacgagccgtcgatcggcctgcaccagcgcgacaatgataagctgatcgcaacgctcaagcgcctgcgcgatttgggcaatacgctgatcgtcgtcgagcatgacgaagatacgatgtatgccgccgattatatcgtcgatgtcgggccgggcgcgggtgtacacggcggcgagattgtctgcgccggaacgattgacgagatcaagggctgcgaacgctccgtaaccggacagtacctatcgggaaagcagcgcattgaggtgcctaaaacacgccggacgggcaacggcaagtttttaaagattgtcggagcggcggaaaacaacctcaaagagatcgacgttgaaattccgctcggcgtatttacggctgtgacgggcgtttccggttccggaaaaagctcgctgatcaacgaggtgctctttaaacgcctgacgcgcgacctgacgaacccgcgcgtcaagcccggcaagcataccgatatagaagggatcgaccaggttgataaggtcatcgatatcaaccaatccccaattgggcgcacgccgcgctccaacccggcgacctatacgggcgtattcaccgatatccgcgagatctttgcacagaccaacgatgcgaaaatgcgcggctacaagtcggggcggttttcctttaatgtcaagggcggccgctgcgaggcgtgcgagggagacggcattgtgcgtattgaaatgcactttctgcccgatattttcgtcccctgcgaggtctgcaagggtcggcgatacaaccgcgagacgcttgaggtcaaatacaagggcaaatcgatccacgacgttctggaaatgacggttgaggaagcgctggagttttttaagaacgtgccgaaaatcgcgcgcaagctccagacgctttacgacgtagggcttggatatgtcaaggtcgggcagccggcaacgacgctttccggcggcgaggcgcagcgggtcaagctggccacggagctttcaaagcggccgacaggacgcaccgtctatatccttgacgagccgacaaccggcctgcacacggctgacgttcacaaactgatcgatgttttgcaggcgtttgtggatgcggggaatacggttattacaattgagcataatttagaggtcattaaaacggcggattatatcatcgatctcggtccggagggcggagacaacggcggcacgctggtggctgcgggcacgccggaagaaatttgtcgggtagaggcgtcttacacgggaaaatatcttaaaaaaatgttataaatttatcaaaattcggcaataataacctttacaaagatatactgtcatggtatagtattgataaagaaagattatcagaaagggagacagcattatgaaaaaatatgtttgcactatttgcggattcgtgtacgatgaggagaagggccttccggatgaaggaattgctcccggcacgaagtgggaagatgttcccgatgattttgtctgcccggagtgcggcgtaggcaaggacatgttcgaagtccaaggttaaggaccagcaatttgtgaccacccggagccgatccggatggtcacaactcattttaacaggaggtcgtttgaaatggcggcagtaaaagttacagacagcatttattcggtggggattctcaatccgaatatgcgcgtgttcgacattgtcatgtcgaccgattatggcaccacttataattcatatgtgctcaaaggcgaaaagaacgttctgatcgaggcgtgccacaagacgtattttgagcagtaccttgcgaatatccgcgaggtcatcgatccgaagaatatcgattatattgtcctcaatcacaatgagccggatcattccggcgctctggcgcagcttctcgattatgcaacgaatgcaacagtcgtcgtttcaaaggccggttcaatctatctgaaaaacattacgaaccgcacggatttgaaggttcaggttgccctggacggcgatgtgatcgatatcggcgggaaaacgctgcgctttatcaacgcgccgtttttgcattggccagactccatgttcacatgggtcgaggaggaaaagacactgtttagctgcgatttccttggcgcgcactactgcgagccatataccttcgattataacatggcctatcccgcaaaatatgaaattgcgttcaaggggtattacgacgcgatctttggtccgtttaagccctatgtgctcgctggccttgagaaaatcaagaatttaccgatcgagcgtgtttgcaacagccacgggccgatcattactaagggctgtcgccttgcctatgtgcttgaaaaatacaacgagtggagccagccgcagaaaaatgcgcggctgaccgtgccggttttttatacctccgcttacggcaacacccgcaaaattgccgctgcgatccgcgacggtattcttgcggcgcggccggaagctgatgttgagacatttgatatcattgactatgatatgggcgagatggccgagcgtctgaacagctcggatgcgttcgcgctcggcagtccaacgatcaacggcgaggcagtcccgccggcatggatgctgctgtcgcatgtcgatgcgatcaacaataagaaaaaaccggttttggtatttggttcctatggatggagcggcgaagcggtgccgaatcttcagacccgtctgaccggactcaaaatgaaggtgttcggcgacggacttaaggtctgctttgtcccgtccggcgcagatcttgaaaaagcgaaggcgctcggaacagagtttggcgcgtcgctcgcatgaaaaaagccccgctgtgacttaacacagcggggctttttccttctatcaaacggttggcggagcggatcgagcctatctgcgtttaaaaaggggaggatccggcttcaaaagtcctttttttacgccgatgcgataactcagacgccaaaagaatatgtacagaattaaaaatacaacgatcatcacttggccaaatgcaccggatttggttggcagattgccaggatcgccgctcatgtcaacataatgggaaaaatcagtgtagaggccgtcataatagtttttgtaggatttttcgtccgaacccgggtgtttccattccacccactgcccgatgggaagcagcgtgtcaggagcaaggggacgcgaatcagtatacgccatatccgtcaaggctttgaaattaatcagggcggcaatccgctcgccgcttggcagatcgatggtataatatgtttgatcgttccatttcagcgctcggtgggagctggcgctcataaaatcgcgcctgacttcgattgtaaaacgccccatctgttccatatctgcgatggaagcggcgataggggtatccggcagggcctcggtaccgacgctgcctggtccgatatccacccgacccatctggtattcgtaaagtatcgggctggctaggaaaccagcgagaagggagaacggaaccgctatcacaaaccccaggatgctggatacaagcatactgaaagatacgcgcacacgcataacagacatattgaaaaaccacctcttgcgatttattgtggttattttatcatgtccgcagcgcggcatgataaaattggctatcagggcggcagcgggctgtgcccgcgtatcgccctggccataaggaataaaataaatgcttttgcatttattttatcacaaacccggatccgtttcaacatgtcaatatgccggctctctttatgttgaaggttgactgatacccatcccggtcatctgccaacgcgctgcggcggttcgtttcatatattgtcatttcagaggaatgaaggtgctgtcggagctccttgctttttgccgggaaaaatggtaagataaactgattataacatgtaaaggggagagaacgcgttttgccacagcagaatttgtcgccggcactcttgcggcagatggagtatagtcggcaggtccgcgaattgctggccgcgcgttacgaccatccgccgatggcctacgtccattcgtttggatgtcaacaaaaccaaagcgatggagagaagatagccggtatgcttgcgcagatgggatacggcttcaccgacgcgccggaacaagcggatctggtcatctacaatacttgcgctgtgcgcgaaaatgcagaggaccgcgtatttggcaacgtcggcgctctcaagtcggctaagaagcggcgcgcaggtatgttgatcgggttgtgcggctgtatgatgcagcagcaggccgtagcggataaaatcaaaaaaagctatccgtatgtcgatctggtgttcggtacgcacgccctgcatacgctgccggagctgctttaccggcgccttttgggagaaaaccgccagttttccaccgaaaatgcgcgcggggagattatcgagggcgttccgctgcgccgctccgggtcaattaaagcaaatctgccggtgatgtatggctgcgataacttctgcacatactgcatcgtgccgtatgtgcgcggccgtgagcgcagccggaaccccggggatgtgctcaatgaggcgcgggcgctcgtcggacagggataccgcgaactgctgctgcttgggcagaacgtcaattcgtatggcaaggggctttcggagccgattaatttcgccgcgctgctgcggcgcgtcaatgagatcgaggacgatttttggattcggttcatgacgagccatccgaaggactgtacgcatgagctgatcgacacaatcgcggcgtgtaataaggtctgccgccatatccacctgccggtgcagagcggcagcgaccgtatattagcggcgatgaaccggcattatacggtcgcgcattatctggagctgatcgactatgcgcgcgcgcgtattccgggcgtcacgttttcaagcgatatcatcgtcggctttcccggtgaaacacgcgccgattttgaacagacgctggagcttattaagcgcgtgcgctttaacgcgctctatacgtttatttactctccgcggcccggtacgaaggccgccgggatggaggacccaacgcccgctgcggacaagtccctgtggctgcgagagctgcttgacgctgaatcggacatccgcagcgggatgcaggctgacgccgtcggtacgaccctgcgcgtactggcggagggtgaagggcgcagcggcgacggctggctgacaggccgcacgcagggaaacgacatcgtcgaattcacggctccgcgcgcgatgatcggcagctttgtcgatgtggcgatcgagcgcgcgcagaactgggcgctgttcgggcggctcaaagagggataaaaagcgttcggaacttatgaacgggcgcatcaatacaggaggaacgaaaaatggatgtaatcgcaatggcaaggcagcttggaaaggcgcttcaacaggacgaagggtatctgcgcctgatggtcgcgcagcagcagaatgacgcggacgagacgctccaggcgttgatcggcaagtttaaccttgcgcgtatcaatttaaacacggagctgaacaagacggacaaggatcaggcgcgcgtgactgcgctcaatgaggaagtccgcgcggtttacgggcagatcatggacaatgaaaatatggccgcttacaataaagccaagacggaatttgacgatacggtcgatttcgttatgcagattctgcgcggaagcatcaacggcgaggacccggatctgatcgagaagaagtccggctgctcgggaagctgttcgtcgtgttccggctgcagttgatccgttttaaagattatgagactgccggcagcgttttgccggcggtcaaaatgtctctggaggtcgcccaggatgaagattgacatgcagaagctttccccgatgatgcagcagtactttgccataaaggaaaagcataaggaccatattttgtttttccgccttggcgatttttacgagatgttttatgacgacgctgttttagcgtcgcgggaactggaattgacgctgacaggacgcgactgcgggcaggaggagcgcgcgccgatgtgcggcgtgccgtttcatgcgtgtgaaacatatatcgcgcgcctgatcaaaaagggttataaggtcgcaatctgcgagcagatggagaacccggccgatgccaagggcgttgttaagcgcagcgtgatccgtgttgttacgccggggacgctcatagagagcaatatgctctcagaggatgcgaacaactatatcgcctgcatcctgttcgatcagggatgggggcttgcgtgtgccgacagttcgaccggccagctctttgtttcgcagtttgcggcggacgcgcagggagaggttgtcaatgagcttgggcgttattgtccgagcgaaatcatttttaacgaggggattcttgatcagacggaagtgaccgcgtttattcaaaagaagctgcactgtgtcgccgacctgtgcgataacgaccggttcgatccgcaggccgccgaggatctgatcgcccggcacttttcaaagccgtccggcgcgctcgggcttgacggccggccgctcgcgtcgcgcgcgcttggcgcgctgctcgcgtatctttatgagacgcagcagaaggggcttgaacgcatcaccgacatcgcttatgtaaaccccgaacagtcgatggcgcttgatttgacggcgcggcgcaatctggagctgacgcagacgatgcgtacaggcgaaaagcgcggcacgctgctgtgggtgcttgaccggacgaaaacggcgatgggaaagcgtctgatgcgcgcctggcttgacaagccgcttgtaaatccggcagtcatcaacaaacggctcaacgctgtggaggagcttttttccgatacgatgctgcgctgcgacctgatcgattcgctgtccggcgtatttgatctggaacggctgatgacgcgtatcatctatggcagcgcgtcgccgcgcgaatacaaagccctggaaggcgcatgccgcaaaatgccggcgctcaaggcgcgcatggagggctgtgcgagcgcgtatctctgcgaggcgcgcgacgcgctcgacccgttggaggatgtgtcggacctgctggcgcgcgccatcgttgacgaaccgcctgcggcggttaaggacggcggcgtaatccgggagggatacagccccgcgctcgacgagctgcgcgcgctcattcacgattcgaaaaagctgcttgtcggcatcgagacgcaggagaaggaaaaaaccggcatcaagaatatgaaaatcggatacaaccgtgtattcggttattacatagaggtttccaaatcaaatcttgggttggtgcccgatacttatattcgcaagcagacgctcgccaactgcgagcggtatatcacacaggaactaaagcagcttgaggaaaaaatcctttcagcgggcgagaggatcgcgacgcttgaaaacgagacgttcgaggcggtgcgcgccgccgtttcagcgcagcttcaccgcgtgcaggcgaccgcgtcggccgtggcgcgcctcgatgtttactgctctctggctgctgtcgcgagtgcgaacggctactgccggccggatgtgggcctgtcggatgggattctgattcgcgacggccgccatcccgtcgtcgagcagctgatggacggcgcgccgtttgtgtcgaacgatacgacgcttgattgcggtgaaaatcagattgcaattatcaccggtccgaatatggccggaaaatcgacgtatatgcgccagacggctttgattgtgcttatggcgcagatcggaagctttgttccggcggcgtcggcctgtatcggtgttgtcgacgggatatacacgcgcgtgggcgcttcggacgacctggcctccgggcagtcgacctttatggtcgagatgaccgaggtggcgcagattatgaagcaggccacgtccaaaagcctgttgatccttgacgaaatcggacgcggcacgtcgacctttgacggcatgagtattgcgcgcgccgtgttggaatacatagcggataaaaagcgcgtcggcgcaaagacgctgttcgcaacgcattatcatgaattgaccgcgctggaggacacgctttccaatgtgaaaaattacaatatcgcgtgcaaaaagcgcggcgacgagctgatttttctgcggcggattgtgccgggcggcgcggatgacagctacggcattgaggtatcgaagctggcgggcgtgccggactggattatccgccgcgcgcgccaggtgctcgaacagcttgagcaggggcgcgaggttgcgcccgcccgtgcggcgcggcaaaagcaggaggaaacagcgccgcaaatgacgtttggatcggccgccgcctcggaaattgaagcggcgctgcgtgcaatcgacgttaatacgctgacgccgattgaagcgatgaataagctttatgaattgaaaacgcttttaaaggattgaaagggcaggtgagatgacgcgtggcaaaaatcaatgttcttgaccggcaggttgcggagctgatcgcggccggcgaggtggtggagcgccccgcgtcgatcgttaaagagctagtcgaaaatgccgtcgacgccggcgcgacaaagatcacagtggaaatccagggcggcggcgtgcgctatatccgtgtgacggataacggcagcggcattctgcgtgaagatgttaaaaacgcgtttttgcgccatgcgacgagtaaggtgcgcgtgcaggaggatttggggcatatcaccacgatgggctttcgcggcgaggcgctcgcgtcgatcgcagcgatgtgccgggttgagatgctcacacgcacggctgacgagatcgctgggacgcggtacacaatttcgggcggcgaacctggagagcttgccgacgcgggttgtcccgtcggcacgacgatcagtgtgcgcgatgtgttctataatacgcccgcgcgtatgaaatttctcaaaaaggacctttcggaaggaaacagcgtggcggccgtcgtcgaaaaggaggcgctggccaatccccaaatttcgtttaagtttatccgcgacggcgcggtgcgccttcaaacgccgggcggcggccaactggccgccgcggcgcgttgtgtgcttggacgcgaattcgcggaacagacgatcccggtgtcgtatgagctggagggcctggcgcttgagggactgatcagcaggccgtcgtttgcgcgcggctcgcgcacgctccagaatttttttatcaacgcgcgttttgtgcgctccaaaacgtgcatggcagcgtttgaggaagcttaccgcaacatgctgatggtcgggcgtttcccgtcgtgcgtgctcaatttgacgattccgccgcagaccgtcgatgtcaacgtgcacccggcgaaaaccgaggtgcgctttgcgaatgaaaagagcgtgttcgacctggtgtattacggctgtaagacggcgctgggcgcgcaccggctcgcaccggagatcaaggcggacgagctgcgttacaatccgtttgcggcgcataccgcccccgaggcgccaaagcagcagcgtatgagcgccgcgcagtaccggatacagaccggcgtgccggatgaacagcccgcgcgcgtgagcgcagagcagtaccgggaacagatgcgcgcgttggagccggccgcgcaggggaaagaggagcggtgcgttttaaatgcgccggagatcgcgccggcgccgcaggctcattcaccgcagacgcgcatccggtctcatcgtgcaattgatattgtgtttgacgagccggatgatgatgacgcacagtctgtttcaagcgcgaatccatacgccgattcctatgcggccgcgcgtcctgtggcgcttgctgcccggacactgccggtattggcggagcaggcgccgccgcgggattttcctgccgcgcccgccggggaagaagcggcgccttccgttatgatacagccggcctgcgcggcggacgatccctatgaaaacgccgtgctgatcggcgaattgtttgggacgtatattgtgctggaaaatggtccggaaatgattttaattgataagcacgcggcgcatgagcggctgctttacaaccgtttggtcgcggctgggcctggggaggaccggcagcttcttctgacgcctgtttcggtgcatctgtcccctgaggagcatgccgccgtgctggagcatgcgccgcttttggcgcgtgctggcgtggggatcgaggactttggcgatgggtttgtcgtcgtgcgcgaggcggcccccgtgctggctgacgccgacctcgcagcgattgttactgagtgcgcgcagaaattgctgctcgcaaacgagcgcctgacgccgcatgtgcttgaggagctgtaccatacaatggcgtgccgctcggcgatcaaggcgcacgaccggacggccgctccgacgctgcgtcagcttgtggagctgctgcgtgccgacggcgacgcggatcactgcccgcatgggaggccggtgtctatccgtatgtcgcggcatgaaatcgagaaaaaattcggcaggcttggatgaacaatgaatgaaacgctaaaaaaacagccgctgatcgcggtggttggccccacagcctcaggaaagacggcgctcgcggtcgagctggcgctttattttggcggggaggttgtctcggccgattcgatgcaggtttataaacggatggatattgccacggcaaagcccgacgaagcggagaaaaagggggtgccgcaccatctgatcgatctgatcgagccggatggcgcggcgttttccgttgcgcagtatgcgcggcgcgcacacgccgtgattgccgatatcgccgcgcgcgggcgcgtgccgattctggcgggcggcacaggtctttatatcgacgcggtcattgacaatattgacttttcaaatatccgcagcgatgaatcggtccgcgccgaactgtacgcgcaggccgaagcgcatggaaacgagcatatgcttgagatgctgcgcgcggtcgatcccgagcttgcggccgcgctgcacccaaacaaccttgggcgcattctgcgcgctttggaggtctaccgtgtgacgggcgtgccgatgagcgagcatcaacgtcgttcgcgtcagacgcctgagcgttatgacgtttgcatgatcgggctgaattttaccgaccgcgcgatgctgtatgaccgtgtcaaccggcgtgtcgacctgatgattgagcgcggcctgatcgacgaggcgcgcgcagtcagcgccgtgtgccgcgggacggcactccaggcaatcggttacaaggaactgatcccgtatctggacgcaggcgcgccgctggaggaatgcataaaccgcctcaagcaatcgacacggcgctacgcaaagcggcagctttcgtggttccggcgcgatgcgcgtatcgtctggctgatggttgataaaagtgaatcgctgcgggaattaaccgaaaaggcggtttgtgtggttcacaagagcggaattctgtgatataattagatattgtaaaaaaggtgaatgggcagtcttggcagcagagccaagcggtccgatgctgcgccgcagcagggaggtaagtatgaagcagctcaatttacaggatgtttttcttaatcaagcccgccgtgaaaagctcacagtgacgatttacctgaccaatgggtttcagttcaaggggattgtgcgcgggtttgattcctatacagtcatcctcgattgcgaaggaagacagaaccttgtttataagcacgcaatttccacgatcagtccgtccaaggtgatcagcatcttggaaacggctgaggacgaccaggatgaagaataacggtaaattatgaaaagtacgctgacgcagcggcttgtcatggcgctggtgacggtattcctgctggcgtatgtgggatatcagatctggcgctatgtgacgcctgcttataaaacggaaacggcgtttacttatacggttacggagacagcgagcgtaaacggcgtcgttctgcgcgacgaggttctgctcgataacagtgttggaaacggagttgcctcctatcttgtgggtgacggtgcaaaggttgcgggcgggaccgtaatcgctgagatctaccgcaataaggaggacgcccggaatattgaacagctgcgcgcgcttgaaaaaaagcgcacgcagctcgagaaagcgcaggacccgggcaccacgtcgtttgcgcatacggatgtgcttaaccggcagattttcagcgagctggatacaatcattggctctgtggaatcgggatcgatggctggggcagctgaaaacgcggacaacctgttgttgcttatgaacaccaaacagattgcaacgggacggcagtcagattttcaggaaacgatcaaccagctcaaggccgaggaaagctatctgtccaatcagatcagccgcgacccgcggcagattaccgcgccgcagcccggctattttatacggaccattgacggctttgaggggaaagtgccctataaggaggtccccgatctgacacgggcgcaggtcgacgagctgctcgcacagccggtacagggtgaatcagaccgcgtgggcaaggtgatgcttggccaccgctggtactacgccgttacggttcccgaggaggatgtgtcgctttataaggaaggcgcttctgtcacgctggatttccatttgtcggggacacagccggttccggcagttgtgtacagcgtcaatgaggataaggacaatggcggcgcagcggtgattttccgctgcgattatatcaatgaatcgcttgtcaatctgcgctttacacaagctgatgtggaatttaaatcgatttccgggctgcgtataagcagttcggcgatccgttacgaaggaatccagaagggcgtctatgtttcacgcggagaaacgatgcagtttcggccggttacaatcctgtatgaatcgccggggtttgtaatctgtcttgaaatggacacgaacaccccggaaggcgcgaatggattgcagcagtttgacgaagtcattattgagggggcgcagttatatgatggaaaaccgcttaaataatctcagcattgcgcagtcggttgaacaaattctggataatattgcaaaaacatgtgcattatgtggtcgcgacgcttcggatgtgcagttgatggccgtgacaaaaacagttgaggcgcagcgtgtgaatgaggccatccatgccggcgtgcggttgcttggtgaaaatcgggcgcaggaactgctggccaagtatgatgattatgaaaaagacggcgtggacattcatttcatcggacatctgcaaacaaacaaggtccgtcagattgtcgataaagttacgatgatccaatcgctcgacagtgtggcgctcgcgcaggagattgagcgtcaatgcgaaaagcacgacaaaaaaatgaattgtctggtggaagtaaatattggaagtgaattgtcaaaatcaggtgttgctcccgaccgattgtctgattttctgggagaactatccggttttggacggatttgtgtgcgcggactgatggcgatcccgcctgtgagcggtacggacgctgaaaaagagcgttatttttccggcatgcataaactatttgttgacattagggacaaaaaattagataatatcaatatggattttttgtctatgggcatgtccgacgactatctgctggcaatcaagcacggttccaacctggtccgtcttggcaccaggctgttcgggcatagggattatggcccggccaagtgaatcagagggggttgtttcagtgggaatcatggataaattcaagaactttatcgggatcccggaggatgagtattatgacgacgaggacgtcgactttatctccagcgacaatggccgcggagatatgcgcgaggacccgccgtcccattccgaaaaacgcgggaacaaggtggttaatatccatgcgaccacacagctgcaggtcgtgcttgtcaagccggagcggttcgaggacgcctccgccgttgccgatcatctcaacgacaagcgcacggtcgtgttgaatcttgaatcgaccaacaaggatgtttcacggcgtctgatcgattttttatcgggcgtcgcatatgcaaataacggacagatcaagcgtgttgcaaacagtacctacattatcacaccgtataatgttgatattatgggcgatctgcttgacgagcttgaaagcagcggcgtattcttctgatggctttggcggataagaaggagcaggcattcgccgcgcatatctgtgacctcttggagattgcccgcaaaagctatacggcgcgattctccggatttctcgacgcgcgccagcttgtgctggcgcgcggatgcgtatccgccgcgggaagcggcgcggagcatttgtttttcggcggctatccgggtgcggagcgtgtgatgctcggcgcgttcgcaccgtatgaacagccggacgaaacttcgtttccaattgtcccgctgaccatcggataccgtgcgcaggacgcgccggggcaccgcgacctgctcggctcgctcacagggcttgcaattgggcgtgaggcgatcggcgacattctggtaggcggggaatacgccgtttgctttgtttcatccgcagttgcgccggtgatcttaaatgaactgaaaaaggcagggcgctgcggcgtgcgtgtgtgtgaaggaatgccggaggttctgcccgcgttgcacaggtatgcggatctgccgctgatcgttacgtcgctgcggcttgattgcatggtggctgccgtcgctgggctttcccgggaaaaggcggcgcaggcaatccgttcgcagttggtagctgtcaacggcgccgtgctggcgcaaacgtctggtatgctctgtgaaggcgatgttttcagcattcgggggtatgggaaatacctgttcaagcaggtattgtcgtcaacgaaaaagggccgcctgcatatcctttgcagaaaatatgtctgatcgggttcgtttgacgaaccgttccaatagataaggaggatgtttgatcgtgctgaatccaaacgagattgccaataaaagatttgacaaagtaatggggcagaaatatcgcgcggacgatgtggacaattaccttgctcaggttgccgacagcatgaacgaccttctggaagaaaagcaggagctggaaaaaaagctgattgttctggcggacaagctggaagaatataaggatgacgaggaaagcctgcgctccgcactgcttggcgcgcagaagctgggcgacagcgtcgttcgtgacgccaaggcaaaggcaagggatattctggaggacgccgaggcgcgcgctaacatgattgtggaaaacgccaaacaggaaatcgagcgccagcaggcgggctttgtgcggatgcagcgggaggtcgcgacgttcaaaagcaagcttcagcttgtgtataagcagcatcttgaactgatcgcgtccattccggtcgatgaaaacattgtgaacgccgcaatgaaaaaaacacagcccaaaccgccggcgccggagacgcccacagggccggacgagccgtctgaccccatgcccgagcagacagttccggaggatgccggcgattctccggcggatctgccggagagtccggacggcctggccggccttcctgtggaggaggacggttatccgctggcggaagatgaactgccccctctgacctacagcgaggaggaaagcttccggtacgaggagacggaggaatatattcccgacggcgagccggacgagccggccaagcatgaatctcgctttgggccgctgaaatttggccgtgaatttgacctgaaacgaaacgacggaaagcgtagacgctgagaacacagcttggtctgcatatccggcgtgaccgatgacaatagacaaacaaggagagatctgtccaatgtccgaaatggattacagcaagacgcttaacctgccaaaaactgatttttcaatgcgcgctgggcttccccagaaggaacccgtcatggtgaaaaaatgggatgaagaacatctgtatgagcggatgcttgagaaaaacgaaggcaagccgctttacatgttccacgatggcccgccgtatgcaaacgccaatattcatcttggcacggcgctgaacaaggtgctcaaggatatcattgtccgccagaagaatctctccggctttaaagcgccatatacgccggggtgggatacgcatggccttccgattgagctcaaggcgctcaaggagatcggagtttccagcgacatcgccccgattgagctgcgccgggtctgccatgattttgcgctgcgcttcgtcgagaaccagaaggagcagttcaaacgcctcggcaccattgccgattatgagcacccttatctgacgctcaagccggaatacgaggcgcggcaggttgaaatttttggagcgatggccaacaagggttatatttataagggattaaagcctgtatactggtgcccgacctgcgaaacggcgctggccgaggcggaaatcgagtacaatgaggacaagtgcaattccatctatgtcaagttcaatgtgatcgacgacaaggatggtgttttggagcgcctcggcgcgaaggatctttctaaaacgtttgttgtcatctggacgacgacgacttggactttgccaggcaatatggctatctgtgtcgggccggcatttgaatattgtgtcgtcgctgcaaacagcgaatattatgtaatggccaaggagcttgtcggggcttcgatgaaggctgccggaattgcagattacgaaatcctgggcacttgtctcggggaggagctggaatacatcacctaccagcatccgttccttgaccggcagtcgcctgtcattcttggcgaccatgtcacgttggagagcggcaccggctgcgtccataccgcgcctggacacggtgttgaggactttgatgtctgcgcgcagcattatccagagattgaggtcgtcgtaccggtcgataaatttggcaatctgaccgaactggccggagaatttgccggtctttcgacggacgatgcgaatgctgcgatcgtcaagaagctggcttctaccgggaacctgtttgccattgagaaaatcgtccaccagtatccgcattgctggcgctgtaaggacccgatcatctaccgcgcgacagagcagtggttttgttccgtcgacgatatcaaggaacagactgtgtccgagatcgaaaaggttgcgtttgttcctgaatggggccgcggccgcatgatcaatatggtgcgtgaccgcagcgattggtgtatttcgcgtcagcgtacctggggcgtgccgattccgattttctactgtaagcaatgcggaaaatatcatgtaaatgaaacaagcattgaggctgtcgcggccctgttcagggaaaaaggttccgacgcctggtatacgaccgacgcggcggatattctgcccgccggcacaaaatgcgccgcctgcggctgtacggaatttgttaaggaaacagacattatggatgtttggttcgattccggaacatcctatgcgtccgttatccacgacaatcccgatttgaagtggccggccgacctctatcttgaaggcaccgaccaataccgcggatggttccagtcatccctgctgacttcggtcgcatggaagggcgtcgcgccgtataagacggtctgcacgcatggatgggttgtcgacggcgaggggcgcaagatgtccaagagccttggcaacggaatggaaccttctgaaatcaccgatcagtatggcgcggatatcctgcgcctgtgggttgcttcagccgattatcatgcggatatccgtatttcgaaggacatcctcaagcagctttccgaggtgtatcgcaaaatccgcaataccgcgcgttatatcctggggaatatcgccgactttacgcccgataaagatgctgttgcctttgaccggctgaccgggcttgacagatgggcgctcacacgtttcaatgaacttgtcaagacggttacagaggcgtatgaccgctttgaattccacatcatttatcatgcgctccacaatttctgtacgattgatatgtccaacttctatcttgacgtgatcaaggaccgcctgtatgtcgaggcccctgattcagaggaccgccgtgcggcgcagagcacaatctacacaatcctgcgcggtatgacgctgctgtttgctccgatcatcccatttacggcggaggaaatttggagctttatgcctgacgacagccgctatgatggtgcatctgtgatgttcaatgagatgcccagggtcattgagggcatttcagatgaggcgtttatggagaagtgggatcgtattcacgctttgcgcgacgatgtgcttaaggcgcttgaggctgcccgtaatgccaaaacaatcggtaaatcgctcgaggcgaaggtagtgctgcactttgacggcagccttgcggagcagatcggtctgacattggatgagctggcaaccgtgttcatcgtttcccaggtggaggttacagcggaaggggctggctcatatcaggggacggttccgttcctgcccggtcttacaattgagattgcgcatgctgacggagcgcattgcccgcgctgctgggtgtacagcgatacagtcggcaaggatgcgcggcatccgacgctttgcgcccgctgcgcacagatcatcggctaatagacacaattgtctgcggcgcttaatgaaggtttaagcgccgcagttttttatcggaataggtggtttctatatgatcattggtatcgtgctggctgtttcagcgtttttggtcgctgtcgatcagcttctgaaggtatgggcgctgcaaacgctggccggcggcccgtcaatcctggtgattcctgggctgcttcaatttacgtatgtggagaaccgcggcgcggcttttggaatttttcaagggcgcgtcgggcttttgtcgctgtttaccctggctgtgattgtcgttgcattgattttgctcatacgcggaaggctgcgccatccgcttttgatgtggagcgtcgggctgattatcgcgggaggtgttggcaacctgatcgaccgtgtttttcgatcgtttgtggtcgattatatcgatatatcaccgctgttcagtttcccggtttttaattttgcggattgctgcgttgtaatcggtacagcgatgctggcggtttatatgcttctgatcgatggacgaaagaaacccaatgggacacaggcaagcggggacagcgatgaataggctgtactatacatccgaggaatctgatgccggcgttcgcgccgaccgctggctggccagcgccgctgaggggctgcttacacggtcagctattcaaaagctgtgtgactgcaaagccgtgcgggtcggggaaaagcctgtttcaaagaatgaccgcctgcgcggcggggagacgtttataattgatgtgccggatgcgcagccgcttgacattgtaccgcaggacatcccgattgagattgtatatgaggacggcgatctgcttgtcgtcaacaagccgaagggaatggtggtgcatcccgcgccgggacatccgaacgggacgctggtaaatgcgctgctgtatcattgtcaaggccgcctttcgtcgatcaatggagtgatccggcctggaattgtgcaccgcatcgataaggatacaagcggtcttttgattgtggcgaaaaacgatgcggcgcatggcacgctggcggaacagatcaagaaccacagctttacacgtatttataacgcggtagtgtacggtggtttttcaacagatgaagggaccgtcgatgcgccgatcggacgaagccagaatgaccgcaagaagatgtgcgtaacagacagaaacgcacgtggtgcggtgacgcattaccgagtgctggagcgtctggggcgtttcacgtggttgaaactgtgcctggaaacaggccggacgcatcaaattcgtgtgcatatggcatatatcggtcatccggtcgcgggcgatcctatctacggcccgcagaagaccatcacaagcctgcatggacagtgcctgcacgcaagggtcattggatttcatcatccgcgtactggtgtatatatggagttttcaagcgagctgccggactatttttctacttttttgacatctctcagacagaattaagtacctgtatttacagccggaagatgcagggcaggcgaggagtcttgtacccgatcaaggaaaatttttgcaggcgggttgtcgcccggcaaaaaattcagaagctgtaccaatggggaaagtgcatggagcagcgagaaaattttccgcctggacatgtgcgtttacccattggtacagcttctcagcgcaggactggagcaaaaggccagcctgcacggcgcttggtgactgtgaatacaggttataaacaaaggagcagggtgtccgccctgctccttcgtttataaggtccgattcgttctttcccgaatagaatagaatatgccatgccaactggcagacatggcataattgcgcagtgcaaacggcaaagccgtttgctgacgctgaatgacggcaggcaagtccatcgggcttgttgctgtggtataataaccgcagagcggctattataccaatcttatggccaaggcgatacgcgggcacggcccgctttcgccccgatggtcgattataccatgccgcttcgcggacatggtataatatacttcatgcgctgtgtgcgcgccgcagtcataggcaaaaatagcggcgcatgaagtagtttttgcgtatgcgggccgtcccggcccacgcgctttgattccgggctgtgccgtcaaaaacggcgtagggccgttttgctatgcgtttgcatagaaaaatgtagagaaggagctgaattggttgcctggtaataactataataacaatggacgccctcaacggtatatcccaccgccgcaaccacagccatatatacagggtgggcgcaattggtcgcataatatcaatagccccggcgttcatggcttccaacagggagggcagcaggcgggttcagaatcaaattgggaggaccaggaccggcagcagtatcgctgatccatggggtttgaaacatccggtgtcagagctgatttaacggacgtgacaccggatgttttttcgaattttacatattttttttcttttttattgcttcggcatagcggcgcagctctgccactgaatgaaattcctcaggccgcttattgatggctcgtttgacgtcttccggaagggagtcaaaataattggccgccgacatatcacagccgaatccataggaaaaatagttggattgttcaagatacatgaaaatcacctccgctatatcatatgcggatcaggtgaatgcaaccgtgtaaatcctggattatttacaaaaaagtgtccgatttgaatcggacacttttgagtactatttcgtttgaggcttcttttcctcagcctgtttggcaatattttgatgtaaatccaggatactttgagacgccaagtcgaaatctctcacttcctcatactgatcgacgagtttactctggacaagatcgctgtaatcctctttcctgtcgcggtaaaccagcttcagaaggattggtgtgatgattgttgtcacaataaccataattacaactgggccaaaaaagtctgcctgcatcagtccggtggaaatacccttggttgcaacaatcaaggcgacttcgccgcgggagatcattccaatgccgatttgaatgcattcactgttggaatagcggcagagctttgcgcccaagccgcagccaagaactttggaaatacaggcccacagaacaagaaaaatcgaaaacaggatgatggaggttgtcattggcggaacctcgacctttgcgccgatgctggcaaagaaaatcggagagagcagcatatacgaagcgatttcaaaccgcgaagctacataggtgacctttttggtgttggaaatgatcaagcccgctatgtaggcgcctgtgatatcggcaacgccaaagaattcttcggcgacataggcaaagatcaggcagaaagcgaaagaaagtacagcgtagcggcgcaggtcgccaggcgcacggctcatccaatattcgatcagcttatgcatgacaatgccagcgatcaggctcagaacgaaaaatgccgcgattttaatcaggacgatgccgattttaacgcttgggtctgcaaagctggtgatcagcgtcagggcaataataccgaggatatcgtcgatcaatgccgctccaagaatcgcgttgccggaacgagtcgatagctttcccatttccttgagcgtttccacagtgatgctgacagaggtagctgtcaggatgacgccgataaagacattttgtaaaaatgcatctgattgcgtgttgaagatggaagcgatgacaaacccgcctgccagcggtacaataacaccgattaaggcgatcagaaaagacgccttgccggaacgtttgagttcaccgatatctgtttcaaggccagcggtaaacattagtacaattacgccgatttcggcgatttgatcaagaaaggttgtctcatgaatcacgccgagacaagcaggaccaagtatcaagccagcaagcagagcgccgacgacctgcggcatggcgatgcgttttgtcagaagaccgagaagctttgtgctgagaagaatgatggcaactgtcatcagaaagctgtaagattccataaaaattacctcctcggatccatacttcaatcttgtccgtctgcgccgtgatatttctgatgctcctccttattacgcttcatttgcggcaattgcgatgtccgacgcagcatgaacgactgaagctggttcctgtggcggacttgcgtcgccgccacgttctaataattcgttccagtgtcttagtatagtccgataccaattgtttttcaacagtcaaaccatataaatttcaatcacaatttgacaaaggttatatgtatttcaagaataaagaaaacaaattcctttgaaacgttgcagattttgaagtggatggtataatataggtgatgaatgatgttgtctttgacgctccatgcaaaaagcattggaatgaatatcgcgctgctgtgccggcgggcggagcgcggtcaaagaaacactggcaggaggagtattatggcggataaatcaaaggtttattttacagatttgcgtgtgcgtttggaggacggccttctcaaaaagctggaccgtttgatccgcgcggcagggatggagacgatcgattttaagaataagtttgcggcgattaaaattcatttcggggaaccgggcaacctcgcgtttctgcgtccgaatttttccaaggttgtagctgacttggtcaaggaaaaaggcggtcggcccttcctgaccgactgtaatacgctgtatgtcggccggcgtaagaatgcgattgatcatattgaagcagcttatgaaaacggatatagcccgttttcgactggttgccaggtgattattggcgatggattaaaagggaccgatgaacagcttgtgccggttgatggcgaatatgttaaggaagccaagatcggccgcacgattatggatgcggatatcatcatttcgctgacacatttcaaggcgcatgaatgtaccgggatcggcggcgcgctgaaaaatctgggcatgggctgcggttcacgcgctggcaaaatggagatgcattccgcgggcaaaccatatgttgagcaatcggtttgcgtgggttgcggtatgtgtaaaagaaattgtgcgcatgatgcgattgccattacaaaccgtaaagcctcgatcgatcactcaaaatgtgtcggctgcggccgctgcattggcgcctgtcctgtggacgctgtacaagcggctcaggatgaagcgtttgatatcctcaataaaaagatttctgaatatacgctggctgtggtcaaggatcgcccgcacttccacatctgtctggtgatgtctgtttcgccgttttgcgactgccatccggaaaatgatttgccgattgtacaggatattggaatgttcgcctcctttgatccggtggcgcttgacatggcctgtgccgacgcagtaaacgggcatccggcgctgcctggtagtctgcttgaaggccgcccggctggcggggaccattttaaggagcttcatccggcgaccgattggcgtgtcggacctgagcacgccgaaaaattagggatcggcagtacacaatatgaattgattgctgtaaaataaaaaagacgggcgagaagcaaaggcttctcgcccgtcttttttcttaattaagtatctgaaattataattgactgtccctcatttgacatcgctttcgtatatttgaagatcatatataccgcatagatcgccaccagtaattcagttattggcatggcaaaccaaacggaatccgctccggcaagaacagggagcagcataatcaaaatgccgctgacgataaagcctctggaaacagatacagtgaaagcggtcttgggcttcattaaagcttgaaaataataggttgaaaagatatttaacggcaatagaatgaatgaaatactgtacgaacgaataatagcaggcgcaatttgcaggatagctgctgtcggtttcataaaaatgtaaatatacagattggggcagattaagctaagaactgtccagaaaatactgaagaagacgactgtataaagagcatagcgcagagtttcttttatccgattccacttcctggcaccgtaattaatcgaaataattggctgtgcagcctgcccaacactgtaagcgcagcactggacaaacgtgcttacatttacgattggcccataaatggctagggcgcttgtccccaaatatttcataatttgccggttgaatagaactgttaaaatccccattgcaatatcaataaaaaacgtagaaaatccagtaataataacttgctttaatttataaacaatatcgacaggcttttgtaaaacaagcgtatttttcttggaccagaaatgtgaaagcataacgacaaatgaaatagcggaaccaatagcggtcgcaagtccggcaccgaatatccccatatcaagcaaaaaaacaaaagcataatcgccaaaaatattaaaaagtccgcctgctaaaacacctatggttgcaagttcaggatggttatcatttcgtaaaaaagccgctaacatttgattgaataaaaataatgggataaccaccttaattggtgccagataagcttgtgccaatgaaagcaattcggtatctgcaccaaaaaatacgaatattggctggtcaaaaaaaatgacagcgagccatacaatcacggaaagtacaatggaaccaattattgctgttgtaaaatattcgttttcattttccgttttctgtgtggacgttcctcggagcgtgctgaaaataacagagccgccggttcccatcaacagaccaaggctataaatgatattccatataggcgcaacgaccgccagcgccgccgtcccactcggcccttggtattgtcctaccattgccatatccacaatggaatacacagatgtaatcattgcgcttccgaatgcggcggataaatacttaaaatagattggtttaatattgctccttaataaaaccattgattttcctccttagacataaaaaaagccggataagaaaacgaacataagcggttttcttatccagcgcccttatacgtaagaggcgccctccgttaaaccgtatattcgctatcttatccggccttatacttacgattataagccctccgataaagtagtgatatattaccagataaaaaaatgcttgtcaagccccattttgctttgaaagcagaataggacatggtgcagcttcggccgcgccatgccccataaaaatggatataatttgaatcctatttttaggacttcccttttagaacatgtattcatcgccggagaatgctggacaagcaatgtggatacccggtcaaggcagacttttgcaaggcgaactgtcacccaacaaaaaaatttaaggcaaagcaggtgcaaaagacctgcctggacagcgttcaacgattgtggatagaggttttaatttgaaattgaaaattttaaccaatgacacaacttgcgcgcctggcgagaagctgcctgattttttcatgtggatcgataatcgctccaaccgacatatcatgattgatggcggcgataaaataggcgatatacttggagacatccacttcgtggaaccattcgcagttgagcaattttggagaacgataagtgagatttgtcccaaagacgcctgcaattgtaccgtcgcgataggccgcttcaaattcatcaacgccgtttgtaaaaattgcgtaggtggcataagcaaaaatacggttagccttgcgttttttcagttcgcgcgcaacctccagcattgattcgcccgaagaaatgatatcgtcagcgataaaaacatctttgccttcgacagaatcgcccagatattcgtgcgcgacaattggatttcggccgttgacgacacgcgcataatcacggcgtttataaaacatcccgagatcaattccaagcaccgaggcataatacatattacggctcatagcgccttcgtccgggctgacaaccatcaggtggtcacggtccagccggatatcagggacgctgcgcaaaagcgccttgagaacctggtaggaaggtgaaacattgtcaaagcccatcaaggggacagcattctgcacacgcggatcgtgcgcatcaaaggtgataatattggaaacccccatattttgaagctcctgaagcgccacagcgcaatcaagcgactcgcggtagctgcgcctgtgctgcctgctgccatacagcacaggcatgatgacgctgatacggtgcgccttgccgctggcggcctgaatcagacgtttcagatcttgaaaatggtcgtctggcgacatcgcatttttctgcccaaacatattataggtacagctataattaccaacgtcaacaataaaatagaggtcatcgccgcggacggtcgatttgataagtcccttgccgtcgcctgatgagaaacgagggcattcgctttcaataataaaggtatctttttggcaagggctgcccgacgcccacctgacaagatgttcgttgattttctcaccaagctgtcgcgcgccttctgtaacaatcagccccaattcggcgacatggccgcattccctaaaaatatcttccgtatcgatctgtcctgccattgcttacgctccttttcaatcgctgcctgtgcgagctattacgctcccacatgacggatctgttttgccagcctccaaaatccgacaaaaagatttatattatattatacatgattgatgagagcttgtacatagacaatcggtaaaaaacgtcttgtatcggtatcccgcaggcaggcattatgaaggagatgggagaggcgctctttccagacccggaaaagccggtctctagccccggttccagtatttacggtcgagcgcgcggtattgcagtgcttccgcaagatgcggcgcgcggatctgttcgctggcatcgagatctgcgatggtacgtgcgaccttgagaatacggtcgtatgcccggccggacagtcccatccggtcgaacgcaccgcgcagaagcttctcggctccgctgtcgagcgggcaggattcggcaagcagagcaggcgggatctgtgcgttgcaggcaataccggtacaggcgaaacgatttgtctgaatggcgcgtgcggctacaacacgcgcccttacattggcggatgtctcctcgccgccaatggccgaaagctgctcatagctgaccggaggaacttcaacatgcagatcgatacggctcaaaagcggaccgctgatgctgttcagataggctgaagcgcgcgccggcgaacaggtgcattgtttggttggatggccaaaataaccgcaggggcacggattcatggcagcggtcagcatgaaccgactcggataacgcagccgggcgttgacgcgtgaaatggtcacgctcccttcctcgatcggctgccgcagagcctccattgccggccgctggaattcaggcagctcgtcaagaaacagaacgccgttatgtgccagcgaaatttcaccgggacgtggaatggaaccgccgccgcacagaccggcgggagagacagtatggtgaggagcgcggaacggcctctctgtgatcaatgggatccccggctccagaagaccggcggctgaataaattttggtcgtctcaattgattccgcctccgtcattcctggaagaatggagagcaggcggcgggccagcatactttttccggtgccgggcgcgccgatcaggagcgtgttgtggccgcccgccgctgcaatttcgagcgcgcgcttggcgaatggctgccccttaacctcacagaaatcgggtactgagcagcggtggggttgattggttttggcgctttcagcccgcaaaagcgtgccttctccgcgcagaaaatcgacaagtgcacgcacgttttcaaccacatagacctcaagaccatgcacgacggacgcctctgcggcgttaggcgctggtacaaaagcacgcttgacgccaagctcctgtgcgccgagcagcatcggtaagacgccgcaaacacgccgcagctcgcctgagagggaaagctcgccgataaacgcagaggctttgggcagttctggaagcgtgccctgtgcgcaaagcagtccaatcaaaatcggaagatcatggagcgagccgctttttttaacgtccgccggggccagattgactgtgatgcgtccatccggaaatgggtagccgcagtttagaaatgcggaacggacgcgttctcgtgattcgcgcaccgctgcgtccggcaggccgacaatttcaaaagcgggtatagcacgcgccacattaacctctacagtgacagaaaaaggctcgatccccagcaggccgagactttgaacggttgaaagcacggcgatccctccagattatattctggtaaaattatacttctgattgacaaaaaaagcaatattttgtcgaatatagaataaaaaaccttttaaaaaagcagattctcattcttaagggagccttagaaggagaatctgcctgctgctgaaatcttatcaaccggatgtcttaaatttttaaattccaaacatatgctctgtaaaaattttcagcccgataccagccagaatgatgccgccgcaaatttcggcgcgtgttccgagcagcagtccaaaacggtggccaagcatagcgccaatgatacaacaggcgaaggtaatcagaccgataaaggccgcggcggtaacgatattgacctgcatgacggcgaagccgacgccaacagcgagggcgtctatgctggtggcgaccgcctggagaacgagaatacgcagggtaaaagcgccggctgcgctgtcacagctttctggatggcgcagttcgcgcgcgccgtcgacaatcattttaccgccgatgatcccaagcagaaacagcgcaatccaatggtcggcaaatccgattgcctcgctgaaagtgcgcccggcaaaatatccggcgatcggcatgagcatctggaacaggccaaaggcagcggccgccgcaaacgcctgcttccggccaaagccacggtaacacatgccgttggaaatggagacggcaaatgcgtccatggagagtcccaaagcgatcataaagagcgtgagtgtagtcatgcggttaaagacccctttattttgtaatgaccttccggctttgtcggctttttagcgaaactctgccaagtatagcactttaatggacatgacgcaaggcatcccatgaaagattttccgttttccaccagatattgtcatacgggcaattgactttgtccttcgggatggttatcatataaataagaaaacataaagagcttgctttttaatattatcattatgttataggagggcgcaatatgaaccatatgcagttgtatgaccgttggctgtcgcattcgcttgaggatgcagacctgatcgccgagcttgaggcgatcaagggaaaggacgacgaaatttttgatcggttttaccgggatctgtcttttgggacagccggcctgcgcggcgtgcttggcgcgggtaccaatcggatgaatatttatacagtccgccgcgcgacacagggactggccaattatctcaacgcgcaggcaaagcacccaaccgtcgccatttcatatgacagccgcatcaaatccgaccgtttttccaaagaggctgcgggcgtgttggccgcgaacgggattcacgtttatatctatcgtgaattgatgcctgtcccggcgctgtcatttgccacgcgtgcgctcaaatgcgacgcgggcattatggtcacggcgtcgcataaccccgcaaaatataacggttataaagtatacggctgcgatggctgccagatgacagaaaatgccgcggacgcggtgcttgcgcagatcaacagccttgatttgtttgacgatatcaggacgctggattttgagcagggaatccacgatgggaaaattgaatacattgcacagacgatcatcgatcaattcattgaaaatgtcctttctcagcaggtcaatccgggcatctgcgcgaaagccggcctgaagcttgtgtattctcctctgaatggcgcgggtaatcagccggtacgccgtgtgctacgtgaaattggcgcatcggatgtcacagttgtagcggagcaggaacatccggacggcaatttcccgacctgtccctttccgaatcctgagattaaggaggcattggccaaagggcttgcgctcgcgcgggagactggagcggatctcatgcttgcgaccgatcctgattgcgaccgtgtgggtatcgcggttaaggacggcgatgattacaggttgctgaccggaaaccatgtcggcgcgttgctgtttgattatatctgccgcaaccgcatagaaaacggcacaatgccaaaggatccgattgcagtgacgacgatcgtttcaacaaagctgacaaacgccatcggaaaagcgtatggtgttgaagtgatcaacgtgttgacaggctttaagtatatcggcgagcagatcgcgattgtggaggcgcagggccatcctgagcggtttatttttggctttgaggagagctatggctatttgagcggtacctatgtgcgcgataaggatgcggttgtcggttcaatgctgattgtcgagatggcgtcttggtataagcaaaagggcatgaccttggttgacgcgctcaatgatttatataagcggtttgggttatattgcgagagcgttgcaaatttccagtttgagggcgcggagggtatgaagaaaatggcggccattatggacggcctgcgtgctcatccgcccaagcagctcggcggcagcgatgttgtttcaacgagcgattatgaagcgtccacggtcgtttcagccgaagaaacacgtccgatttcgctgccgaaatcaaatgtgcttgagtatgcgctcgccaacggctgcacagcgatcgtccgcccgtccggcacagagccgaagattaagctgtatctttcggcggtcggcaaggatatgggggaaattgatgcgcgcgcggcggctattggaacagatgtcaagaaaattatgggcgtttaatagatcaaaaagaaaatgattgcatatgggaagctgtaccaaagggaggcgcacacgtctaggcggaaaatctcccgtctgaactgcttcaaaaaagcttgaaatctgctgggattttagccggggcggtatttattctgttggcgtttttggtgaacgctgccattacggacaagacggggaaatcctcccggctgctcagtccgatttattacgttgttgtgattccgacagttttggtcaacctggtccggtcggttgcggtctataattgggggatctggctagcaaatcttctggtgctcatatgtgtgggagttgctttctggcgcagcgaacgggatgccgcagactcagggcagcgggagagtggtttgaaatagcttttgggctacaaaaatccgcaccgttgaagcggtgcggatcagtcctgtctcggacgcctattcctgcgggtgcgttccgacagaggatgcggatcccaagggttcgtccgctgtcggagcggtggaaaggtggttgcgctctataacgagatgatggatgcaatgcttgagattgaggcgcgctgtgggaagcaccgccggataaacaggcagtttcgtgaaccgatcgacacgctctttttgaaggcgcgcaccttcctgacggcgagcgagcacttggaaaacttacggacgagggctaataaacaggcgtttgacagcttcctcagggatcagggaagcgaccgcatggtgctgctgcgccggattaccagcggagcgggggaacagtttgtgagcctgagcaagcagtatgacctcgcagcgcgtgaggcggccgcgcttttcgtcgcgctttcctttcgcaattaatattacaattttcaaaagacaaaaatatttaaaaaaagccttgtaatttgggacgcactgtggtaacatttaaatgttacatttatggtatctagagccgataccagaaagaggtgaaacaaatgaaagagggcatccatcccaagtatgtggatacgacgatcacatgcgcctgcggcgaggtgatccatacacgttcgacaaaggaaaacatccgtgttgaaatttgttcgaaatgccatccgttcttcaccggccgtcagaaactggttgattctggcgggcgtgtcgacaggttcaaaaagcgtttcggcatggacaagtaagctctttgtgcaaagcacgcagccgcggtttaaccacggctgcgtgctttggcgtttgggggaaggggaatggcttgtatgggtaaacgccggctcgattttgtgatcccacccgaatatgatggccgaaaggcgattcactttttgcgcggacctgcgcaatgctcttatactttagtgcgctcgctcaaaacgtttgaggatggcattctgctcaacggaacacgcatccgtacaatcgaccggctacataccggcgactgcctttccattacgatctgtgacgctccacaaacctttgagccttgcgaaatacccgttgaaatcctgtacgaggacagcgatgtgatcgtatataataaacctgcagccatggcttgccatcctgtgcgcggtctgcgtcaggggacgctggctaatgtgtttgcgcgcgactgcgccgcaaacggagagagctgtgcctgccggcttgtgggacggctcgaccgcgatacaagcggagcggttgtaattgcgaagaatgcgcgcgcggcggcagtgcttatgggacatgttgagaaacaatatatcgcgcttgtaaccggtatgccaaatccaaaacatggtgtgattgacgcgccgatcggacagcccgatcgaaagaacccgcggcgtatgattgtggcgaacggtaagccggccgttacagagtatgagacacagatacgttgtgaggggtacagcgttgtacattgtgtactgcgaacgggacggacacatcagattcgggtgcatatggcatcaatcggatgtccactgcttggcgacacgctttatggcggtgagacggagcggatagagcgtcaggcgctgcattgtatgcaggcatcttttatccatccggtagacaagcggctttgcattgtgcgcgctcccattccaaaagatatgcaaaagttgataccgctcaatcagtaaacatagtaaatgtgcataaaaataaatttgtgtgaatatttcttggtaaaaacgcttgcattaagtggttgaatatgtataattataaatcaatatacaaacattatacgtttgtagcatacggccggccagccggcctgattgggaggaaataaaaatgaaaaagatattgtcagtcatccttgcggcgatgatggccgcgtcattggcggcttgcggttcttccggcggcgcaagctccagccagccggcggcgcccgcgtcatccgccgctggttccacagccgcgaattcagaagctgcttctgccccggcggagggcgcgatcacgtcggcggctgacctggcgggcaaaaagatcggcgtgcaggctggtaccaccggcgaggtatatgtgcaggagaatgttgcggatgccgagcttggcagctataaatctggaatggacgccgcgctcgacctaaagaacggtaagattgacgccgttgtgctcgacgagctgccagctaaatcgatcgtcgcgcagaacgacgatctgatgatcctcgatgcggatcttgcaaccgaggagtatgcgattgccgttaaaaaaggaaatacggaactgcttgaagcgatcaatgccacaattgcacgtatgcaggaggacggcacctacgaatcccttgtgaatgcgttcatgccggcaggcggagacagcgagatcaaaatccccgatgctgtcgggacagaaggcgacaagacgattaaaatgggtacaaacgccgctttcaagccgtttgaatatgtagagggcacagaggttgtcggctttgacatttctatggcgcagcagatcgcgcaggacatgggcgccaagcttcaggtcgaggatatggcgtttgacagcctgatttctgcgcttgacgcaggggcgattgactttgttgcggcaggtatgacagctaccgaggagcgccgccagagcgtcgatttctccgacccgtattattcttcaaagcaagtcatcattctcaagaagtaaatatacaagaaaagttgtgggcggggcgtcagccccgccctgcttaatatccggaggggtcgtacagctatggatgcactctatcaaaacctgatcgccttagaccgctggaaactgattttaagcggtctgggcaccacaatctgcatcgcgctcggcgcgattgtcatcgggacgctaatcggcgctgtcctcgcgctgatgcgtatttcacgcagcaggctcctgcgggggatttctacactgtatatcacggtgatccgcggcatcccgatggtgacgcagcttatgattttttactttatcttttttgcgccgacgaatgttccgaagctggtggttgcaattatcagctttggcgtgaattccggcgcttactgcgcggaaattttccgttcgggtattcagggcgtgccggtcggtcaggtggaggctggacggtcgctcggcttgagcggcgcgcagactatgaagctgatcattttgccgcaggcgtttaaagcggttctgcccacctataccaacgaatttgtcgtcttgatcaaggagacggccgttgcaagctatattgcgctggtcgatttgacaaaggcgaccgaccagatccgcaacgcaacctttaatgcatgggtcccgctgttgacagccgcggtgatttacctgtgtatgacgctggggctttcggccctgtttgcacggcttgagaggaggatggcgcgcagtgatcgaggttaaaaatctgcaaaaatccttcaagggcgtcgaggtgctcaaggggatcaatgagacgattgaaaagggtgaaaaggtagtgattgtcgggccgtcaggctctggtaaatcgacgtttctgcgttgccttaatcgcctagaggagccaaccggcggcgaaatctggtttgaaggaaccaatatctgtgacaaaaagtgcgatatcaaccgcctgcgccgcaagatgggcatggtgttccagcagtttaatctgttcgcgcacctgtctgtgcgtgaaaatatcacgctcgcgcccgtccggcttaaaatgatgacgcaggaggaggctgataagcgtgcgatcgggctgttggagcgcattggcctggcagataaggcggacgcttatccgtcgcagctttccggcggacagcagcagcgcattgcgattgtacgcgcgctggcgatgaatccagatgtgatgctttttgacgaaccgacctccgcgctcgatccggagatggtcggcgaggtgcttgaactgatgcgccagctagcgcgcgagggcatgacaatggttgtggtaacgcacgagatgggttttgcgcgcgaggtcgccacacgtgttctctttatggatgagggacgtatcgttgaacaggcgcctccagaaacattctttacgcatcctgaaaatccgcgcctgcaggattttttgtcaaaggtgctgtgacttgacggcgctgtatcttttctggtatagtttttttaatggcgcggatcaattaagcggcggagcgcaccagggtgcgctccgccgctttcgtatatttttcgcggcgcaaggattctggtgcaagtacagcgccgcaggtcttttgagtcaggaggatacatgaacatactttttttcggggatgtggtcggacagcccggctgcgacaaattgcggcgtgagctgccgcgtctgcgccgtgcatatgatgcgggtattgtcatcgcaaatggcgagaattcggccgaaggcaatggaatcacgccgcacagcgcgcagcatctttttgacagcggcgtcgatgtgatcacgaccggcaaccatgtgctgcgccgccgcgaaatttatccgaagctcgacgagcaaaacggaattatacggccggcaaattatcatccttccgcgccgggcgccggctggtacctttatgacagtccagcgtttccggttgcgattatcaatcttcaagggcgcgtctatatggagccgcctctcgccagtccatttgacacggccgacgtattgctttctgagattaaatgtccgaatattgtcgtcgattttcatgcggaggcaactgcggaaaagcttgcgctcgcacattaccttgatggacgcgtttcagcggtgcttggtacgcatacgcatgtgacaacggccgatgaacgtctgctgccaaacggtacggcgtatatcacggatgtcggtatgtgcggcggccgtaattcgattcttggcgttgaaaaaagccgcgcgattgaaaagctgcgcacaggactgccgcatcggttctctaacgacccggaacagatcgaactgcatggcgtgcttttgacattcgaaggtacatctgggcgcgttggccgtattgagcgtatttttgcgccggcctagattttgtttgaaaagcagcggggagaggaaaaatttgaagtatcgttgtccatgttgcggtttttatacgtttatggaacgaccaaacgggaattatgatatatgtcctgtatgtttttgggaagatgacccgatacaaatggaggatgaaacctttgagggcggtgcgaacactgtaagtttgcttcaggcacggagcaattttattgaatttggggcttgtgaaaagaatatgagaaaatatgtaagagaaccgtttgaagatgaaaaatatggaatagattgatttattatttaaaggaacagaagatagcaaaatagaggggataaatgttcagatatttttaaagccccctcagttttttgcagccggcggcctgctccatggttggtatgcagcggaatgtaaactgttctaaagtttcgttgaaatatgtggcagtatagggtataatatgcgcagggcgaacggttttgccgtttgcggccgccagacggcaaaaccgctgcaaagtagcggactacgcgcatttcatgccggttgcgcagttatcgtcgtttgtgttatataatgagctgcgatcacagtttatattgatgggagaatgcgatgacgcacagaattttggcgcttttggcagcggttgtgctgcttttcgggggatgcaggcgtacagttgtaagcgatcagcagtttgacattgctgcgcagcgggcgcaggcttccgcgccagcacagcgccaggagcagtcagaggagccgctgacaaccctgagcctggcctacagcgtatccgattcgttgaatccatttttgatgaaaacacagatgaatcgtatgctgattccgcttttgtatgacagcctgacgagggtggataagacttggcgtccgcagaacatattggcggaagaaattacggttgaaaacaaactgtgcacggtcaagctgcgttcgggcgtcgtgttttcagacggatcaccgctgaccgggaaggatgtgatttattccattacgacggcgatggcgtctaacactgactggaaaacgacgctgcaaaatatttcaggctgctcagtcaacgacgacggcgcagttgaaattcgcctttacagttccgacgctgactttgccgccctgctgtcatttccaattgttaaagaggggacggctgcggacgattatccggtcggcgtcagcaaatactttgtttcaggcacatggggcggaagcggtgtgacattgacgcgcaacccgatctattggaatccgcagtcggtgggttcagttgaaacgattcgtttggcaaatgtttctgatccagatgcgctttcgttcagtttacgtacaggagacatcgatttgatgtattccgatctgagcgatggtgattttacattttcggctgcttccggcgtgccggtatctctaaacagccttgtatacatcggtgtcaatggaaatcggggactgctgtccgaagcgcagtttcggcaggcgctttcccttgctatcaaccgtgatgagctagttgcaaaggcatatatgacacatgcacgcgcgacgctgtatccgtttaatccggagttttacagaatggaggatcttgagctttcgacgccgcgcgagcttgcgcgtgcagaggaacttcttgccggcatgggtctgacccaaaaggatgaaaacggctaccgcttgagaaacggccaacccgtgacgctgcgcctgctggtcaacagcgaaaatgcctgccgcaatgcagcggcaacactgcttgccgaacagcttcgccagcttggcgtacaggtgactgtcgaatcgcagtcgtttacacagtaccaggctagcctttcgcgccgtgactacgatctgtacatcggcgagacacgcttgatggataatatggatttttccgtcctgctctccggaggggcgctcagctattcaactccatatatcgaatcgctttctgagctttatgggtcttatcgttcgaccggggcggggatcgggacgttttgcgaagcgtttgctgaacaatcgccgtttattccgcttgtatttcgacagggacaggtatcgtttaatcgttcgttcgatgcgcagattgtcgccacagaacaaaatcttttttataatttgtctgaatggtagcattgctttaatgtgtgagaatacagggaggttttgacattgatcagtttggaaaatcaatatgggacgattgaaatatcccaggaatattttgcaaatcttgtagggcgcgctgcgtcggagtgctttggagttgtcgggatgatcagctcgcccacacagggaatccggtcgatcatgaacggcggcaaggatgttccagataagggcgtacatgtgcgcacctcaggcggagggctgatcgttgatttgcacatcgccgtcgtttatgggatgaatatcgctgcgattgtacgcagtatcgtcaacaaggtgcgttatacagtcgagcaggcgacaaaccttgaggtagctaaggtcaatgtattcgttgacgcaatgaaaacagaaaacgcataactgaggcggacaaaagtgtgaatatgggggtcattcaatcatgattacaggccagatgctcagggatgcgttcatctccggagccaacaatatatcaaaccagcgtcagcttgtcgacgcgctcaacgtgttcccagtgccggacggcgatacgggcacgaatatgtccatgtccgcgtcggccgccaagcgtgagctgatgcgcattcccgacagcgcgcctgtttctcaggttgcggatgcgtgcgcctctgctctgctgcgcggcgcgcgcggaaattcgggcgttattttatcgcttttgttccgtggattttcgcgcgggctgaagggacgggagcaggcggatgcaagggatttggttgacgcactggaaaggggcgtcgaatcggcatataaggctgttatgaagccgacggaaggcaccattctcaccgttgcgcgcgtagcggccgaacgggcgcgtgaggcgctgaccaacgaaatggacacagcgcagatatgggacgttgtgcttgacgctggatgtcaggcgctcgacgagacgccggagctgctgccggtgctgaaaaaggccggcgttgtcgatgcgggaggccgcggcctgatcgtcgtatttgaagggatgtcggaggtatttcatggtaaaaagggaatcgagcctgccgttgaaaaatcagccgccgcagacagtgattccatccacccggaccgcaacgcggctggcgaatatgtaggggagatcacgttcacatattgtacggagtttcttgtgaaaaagcgcgcgcgggatatcgaccctcagccattgcgcgcctatctggagacgattggcgattgtgttgtcgtggttgacgacgacgacatcatcaaatgccacgtccacacggatcatcccggcctggcgctcgaaaaagcgggtgaggacggccaattaacgaacctaaaaattgagaatatgcgcgagcagtatgaggcgcagaaggccagcgttgtcgaaccggtatccgatcaggggtttgcatacgcgccggttgacccttcccgcacctatggctttgtcgcggtcgccgcgggcgacggcgtaaagaagctgtttgaggatttgggcgtcgacaacattgtcaacggcgggcagacgatgaacccttcaacggacgatatcctgtccgcagtccatgcgacgccggcaaagaccgtatttgtgctgcccaacaacaaaaatatcattatggcggcggagcaggcgacaaagctggctgaccggcgcgtgatcgtgcttcagacacgcaccattccgcagggcctttcggcgatgcttgcattcgatgccgacgccgatgcaactgaaaatcaggtagccatgcagaaagcatatgagcgcgtcgggacaggacaggttacgtttgcggcgcgtgacagcgattacgatggccacaaaatcaaggagggcgagctgctggggcttgaaaatggcaaggtcgcctttacggatcacgatctgacgcacgccgttgtgcgcgtaacacgtgcgcttgtgcacaaggacagcagttttgtaacgcttatttatggcgaggaaatctctgacgagcttgcgcagacgatccgcgatgccgtcgccgccaagctgcctgacgatattgaagtcgcgcttattaacggcggccagccggtctattacttcaccatttccgtggaataactttaagcggatgatagccgttggatttactatgaaaaattaagagaggtgttcaaagatgcagcatgaaaagatgcgccgccttgttctggcggcaatgttcgcagcgatcacagccgtgacggcacagcttgtcatcccgcttgggtttacgccggtgccgtttacgctggccctgatcgcgatttttctgacaggcgccctgcttgatcccaaaacggcgtttctggcgcagcttgcttatctgctgataggcgccgccggcgctccggtattctcctacttttccggcgggcttcagaagcttgcggggccgacgggcggctatctgctcgcttatccctttatggcgctgaccgcggcgctgtttttgaagcggtttggacgcggtttcctgcgttattgcgctgctatgctgctttcgctgtttgtgtgctatacgctcggtacgctccagctgatcgtcctttcaggtatgagtccaatggaggcgcttgctgccggcgtgctgccgttcgctgtgttcgacattgtgaaagcggccatatcggcggtgctcgcaagtgcgctttatcgtgcgctgggccgtgcgcggctgttggccgccgtcatatgaccgcccgcgaattggtgcaagcgccgtgacacgacgtatagggcggcgcgtcataggcgcgctgctctgtatggtgttgctctgcgcctgcgccaagaaacagcctgtacaggccgttccggaaccaaagccattaagctgcgtcacgcaggacggggcgatttccttcgtgtttggcgcggattggacgcaggacgcgcaaagctatgcatacgatttactttgctatgccaaaacgcgcgatctggctgccggcgtgttttcctacacgcgggcaggcgcggcgcaggcgttcgatccggcgcaggcgcttgatttccatgtgaaggatttcgccggtaaacgggaaaatgcgcggatcttggaggaacatacagtccgtgaggacgacgggcaccgctatacaacggttcttttggcagctgaatcggatggggagaaactggcttattatttcacgctgattgaatttgcgggatattccgatgcgttcgcggttttggtgcaggcagcccccgcagaatatttcagcgaatgccgggaggaatttgacgagatcgccgcgtcgtccgctttggtggagcagtcggaaatgccgaagtccggcttttcggtctgattctgatggaatgtaagcaaaaatacgcgctgcggttgacttccagcgcgccaaggtatatacttaatatccgtatggaccatgaaggggtcaaccgtggaagccgccgcagagaggcgcgcgtatgctgtgagcgcgccgcggaaagaagcggacgccgccccggagtcctccggcggcgagccggacgttgtgtgagcgttaatcctgatgagcggcgcgggcgactcccgcgcaattttgggtggtaccgcggaaagccgatgcgcttttcgtcccatgttttggggcgagaagcgcattttcgcgtccggggaccggcaagtatggaaaggaacgattgagacaatggaatggacaggactcaatgaactgcgtgaaaaattcctcagtttttttgagagcaaggagcatctgcgcctgccaagttttccgctgatgccttcggcggacgaggccagtcttctgctgattaactccggtatggcgccgatgaaaaagtggtttctggggctggagacgccgccgcgccgccgtgtgacgacgtgccaaaaatgtatccgcacgcccgatatcgaaaatgtgggtaaaacggcgcgccacggcacctattttgagatgctcggaaacttctcgttcggcgactattttaagcatgaggcaactgcctgggcctgggaattcatcacaaaggtgctcgaaatgccggttgaccgtctgtgggtatccgtctatgaggacgacgacgaggccgaacagatctggacaaaggaagtaggcgtcgatccgtcgcgcattgtacggctcggcaaggaggacaacttctgggagattggttccggtccatgcggtccgtgctcagagatctattttgaccgcggcgaacagtacggctgcggcaagccgacctgcggcgtcggctgcgactgtgaccgctatgttgagttctggaatcttgtgttttcccagttcgacggcgacggcaacggccactatgaacgcatggagcatccgaacatcgacacgggcatgggcctggagcggctggcctgcatcatgcagggtgtcgacaacctctttgaggtcgacacagttcagaatatcttaaaacatgtcgcgcggatcgcgggcgtggagtaccatacggatgcgaaaacggacgtttccctgcgcgtcatcaccgaccatatccgttccaccacatttatggtcagcgacggaatcctgccgcagaacgaagggcgtgggtatgtcctgcgccgcctgctgcgccgcgcggcgcgtcacggacgcctgctcggtatccacgagccgtttttgtatcaggtttgcgagacggtcatccaggaaaatgcgaacgcatatccggagctggttgaacaccgcgattatatcaccaaggttatcaaggtcgaggaggagcggttcgcccgcacaatcgaccagggtatggagctgcttaccgcgatcatcgacaagatcgattcggagatggacaaaaagatcatgcccggtgcggatgcgttccgcctgtacgatacgtatgggttcccagttgacctgatccgtgaaatcctggccgagcgcaagatcaagctggacgaggaggagttcgcccgccagatgcaggcgcagaagcagcgcgcccgcgaagcgcgcgccgcgctcggcgacctcggatgggaggaggacgtgcttgccgacgtagccgatcacggccgctttgtcggatacacggaaatggccgcgcaggcacatatcgtcgcgatcatcaaggatgacaagcgcgtcgatgagttgcacgacggcgagcttggatcaatcgtgctcgacgttacgcccttttatgccgaaagcggcggtcaggcgggcgacagcggcttgattagcgcgggtggaaacgtattcgcggtttacgactgcaaaaagtcaaaaaccggccactttgtccacatcggcgagttgaccgccgggacgcttgcggtcggcgattctgtttcggccgcaatcaacgtcgatcgccgcgccgatatcatgcgcaatcataccgcctgccatctgttgcaggctgctctgcgccaggtcctgggcgaccatgtacatcaggcgggcgctttctatgacgatacaatctgccggttcgacttcagccatttttctgcggtcacacctgaggagctaaagcgggttgaggagcttgtaaaccgcgttgtgctcgcttccatcgacgtttccgtcagcgagatgccgatcgacgaggcgaaaaagctcggcgcaatggcgctgtttggagaaaaatatggcgatgttgtccgcgtttgcagtgttccaggcgaatcggttgagctgtgcggaggtacccatctgaaaaataccgcgcaggttggcttgttcaggatcgtcaaggagtcatccgtcgcggccggcgtgcgccgcatcgaggccgtcacgggccgcaatgtgctgcgtctgatggatgagcaggaaacgacgatggaaaagacggccgccgccctcaaggtcggcaatctgtctgaattgccggcgcgcgccgaggcgcttaatgcggaaagcagggagcagaagcgccggcttgaggcggccgaggcaaagctggccgaatcgcagctttcaggagtgtttgacaatgcccagcaggtcggcggcatatacatcgcgtctgtcgcaatgatgggagcgaagattgacgcgctgcgccgtatgggcgaccgtgtgcgcgacagccgtccggatgctgtctgcgccttctcgactgtcaatgacggcaaaggttccattctggtcgtctgcggcaaggacgcggtcgctaagggtgcgcacgccggaaaaatcgtcaaggagctgactgcgctttgcggcggcagcggcggcggccgccctgacaacgcgatgggcggcacgtctgaaatatttcggatcgacgaagcaatggcgcagctacccgcgattgtcggaaagctgttaaaataaacgtacaaaaggaggacaacaatggactgcctgttttgtaaaattgtggcgggcgaaattccgagcgataagctctatgaggacgatatctgttacgccttcaaggacatcgacccgcaggcgccggtgcatttcctggtcgttcccaaggcgcatatcaccggcgccgaccagattacggaggacaacgccccgacagtcggccgcatattcgctgtgatcgcgcgcctgacacagcagcttgggtgcggcggcgattaccgtgtcgtgaccaactgcggcaagctggctggacagacggttgggcatctgcattttcatgtgctcgcagggcgtagcctcgcttggcctcccggctgatcctctgacttccatattaataatttattacctgaaaattcctgtttgccttttttacaaacttgcaatcaacaaccccgcgccagccgcaaagcggcaggacggggttgttttgtctgttttgatatgaaagaaacgccagagaactggtgcgcttgtaaaacagcctgtcgcgtggtaaagtataagggcaacctgattgataggaggagcctgtttgataaaaataaaaaaaattgccgcgctgctgacagcgggcatgctcgcttttttcacagcggcctgcaacggcccggttccgtttggcggggctggagaggacggcagccgtgcaaatgcggacgaggaacgtgcgcgcttcgatgaatacctggaggaggattttgtcgcaacactggaatccgatcttttaacgctgcattatacgctcaaagacccggcggcatatggcattgaagatgtggaaccgacctttggggatgtgcagccgccgctgctttccgactacgatgaggaaatcgaccggctggaaggatttgaccgttcccttctgacaaaggagcagcaggagctttatgagatgctgatgcgcttttaccggcaggagcgcggcgcgcttgagcagggatacgcctattattcggagccatgtgcgcccgatggaggcgtgcaggcgtcgttgccgatcaccctgtccgaatatcagttttacacagagcaggacgtgcgggattacatcgctttgcttggagacgtgggacgctattacgacgacctggtcaagtatgaggaggaacgcgcccgccgcggcctgtttatgacggacgatatggttgatcaggtgattgaaggctgtcggacttttatcgccaatccggaacagaatgttttaatcgcgacatttgagacgcggctggatgcgctcgacagccttgatgaacaggcgcgcgccgattatattaaacaaaatcatgcggcagtcatggacacggtgattccggcctatgaacggatgatggaagggcttgagaagctcaagggaacaggcgtaaatcccggcggtctttcacatcttgagaaggggaaggggtattatgaataccttgccaggagcctgaccggcgttgatgcagccccggatgaactggcccgccggatcgatgaacggtttggcgaactgttttcacggatgttcctgctgttgggtgaggatgaaacgtcggaacgtctgataagcgagatggaggcgtttttggaagctgaccgcggcacgccgcgcgaacagatcgactttttgcatgcggcgtcggagaggattttcccggacgcgggcgacatttcctacaatgtactgtacgtcgatccatcgctggaggacagcaccgcaccggctttctacatgatcccgccggccgatgcgccggctgaaaaccggctgtatatcaatcagggccgcgattcgggaaccatcctctatgccacgctggcgcatgaggcgtatcccgggcacatgtaccaaaacaattactttatttccaccgggcctgccatgctccgccatcttctttcgtacatgggctacagcgaaggatggggcacctatgccgagctgtattcctatgagctggccggccttgacgatcccgcgctgatcgagctgctccagatcaacaatgagttttctctcggcgtgcttgcgcgcagcgatatcggcatccattaccagggctggacagtcgaacagttcgccgcgtatctcgatggctttggatttgatacgagcgacgcggaagatttttattggatgattgtggccgatccgggcgcatatctgccgtattatatcggctatcttgaactgatcgacattattgacgacgcgcgtacacagcttggcgaccaatttgacatcctcgctgtacacaaggcgattctggacgctgggccgcagccgtttgacatggtgcgcgcgcatgtgcaggaatatgtcgatcgtgtacgcgggacgcaggcttcgggcagcccggcgcaggccgcgtaaagggctggattttgaaggtaagctatgctataataccattcatcaacattgggccgcaggtgcattgcgcaaaacggccgcaccggaaagagggagcattgtgaaaaggacagaaatcaggcagctattcgctgcgccggagtcatttgacggcgccgaagtgactgtatgcggatgggtgcgtaccatccgtgattccaaagccatcggatttatcgagctgaacgacggttcggcgtttaagaacctccagatcattctggagacggagaaggtttcaaatttcgcggagatcgtaaagctcaatgtcggcagcgccatctgtgtgcgtggccgcgtgatcctgacgccgcaggccaagcagccgctggaggtccacgcggacgaggttgtgctcgaaggcgcgtccacgccggattacccgctccagaaaaagcgtcatacgctggaatttttacgttcgatcgcgcatttgcgtccgcgcaccaatacctttgaagcggtattccgcgtgcgaagtgtggctgcgtatgctatccaccgctttttcaacgagcgcggatttgtctatgcgcacacgccgctgatcacgggaagcgactgcgagggcgccggcgagatgttccgcgtcacaacgcttgacccgaaaaacccgccgctcaccgaggatggcgctgtcgattttgcgcaggatttctttggaaaggccaccggattgaccgtttccggccagcttgagggcgagtgcatggcaatggcgttcggcaagatttacaccttcgggccgaccttccgcgccgaaaattccaacacggcgcgccatgccgccgaattttggatgatcgagccggagatcgcctttgccgaccttgcagacaatatggagcttgcggaggatatgatcaaatatgtcctttcctatgtgctggaacagtgcccgcaggagatggcgtttttcaacagcttctatgacaagggattgattgagcggttggacggcatcatttcttccgacttcggtcatattacctacaccgaagcgattgagatactggagaaggcgaaggatcagttccagtatcccgtttattggggctgcgatttgcaaacggagcatgagcgttatctgaccgagcaggtcatgaagcgtccggtgttcgtaacggactatcctaaggagatcaaggcgttttacatgcgcctgaacgacgaccggaaaacggtcgccgcggttgacctgcttgtcccggggattggggagatcatcggcggcagccagcgcgaggaacgccttgacgtgctgttgtcccggatgggcgagcttgggcttgatcctgctgattatagctggtatctcgatctgcggcgctacggcggtacaaagcatgccggttacggattgggatttgaacgattgatcatgtatatgacggggatttccaatatccgcgacgttttgcccttcccgcgtaccaccggttccgccgaatactgataacggcgcccgttccgcctgacaggcggggcgggcgttttcaactgaaaaacagtcaaaacttgggttgattctcgttcagaatcatgaattttgcaagaatcaaaaattaatcttgcaaaaaagatggatttcgcatatactatagaagtagaaacaatcgctttggcggttgttttgttttggatttgtgtgtaaaacggcggcgccagccggtccggtttatgcaaaacgccgttcagacagcaaaacagctgtccaggccgcttgcggcctgacgcaaaagtattcgccgcggccttttaaaaaagagccgggcatgggaggattctaacaatgtcattattcagtgaactgagccggaatgaactgaagaagctgcatacagaattgctcggacaatatgaggattatcagggaaggaatctcaggctcgatatgtcgcgcggaaaaccctcgcctgaccagttgaatcttgtgagcggtatgctcgacgttgtgaattcgacggcttcaccactgtcggccgatggtgtcgattgccgcaactacggtgattttgacggcatccccgaatgcaaggccattttctgcgatatgctcggcgtcagttttgacgagctgttcatctgcggcaactcaagcctttccatcatgtacgacgccatcggcaagatggttctgcacggcgtgcgccctggcgcaacgccctggtgcaagcttgaccgtgtaaaatttctctgtccggttcccggctatgaccgccattttgcgatcaccgaacggtatggtatcgagatgatccctgttgatatgacgcctgagggaccggatatggacaccgttgaacggcttgccgcatcggacgcttcgatcaagggcatctggtgtgtgccgaaatattcaaatccggacgggattacttattcggacgagacggtccgccgctttgcacggatgaaaacggctgcggatgattttatgatcatgtgggataatgcctatgcagtgcatgatctgcatcctgagcatcgcgacacgctgatcaatattcttgatgaatgcaagaaggccggagatccaaaccgtgtgatgattttcgcgtcgacgtcgaaaattacctatgcgggcgcgggtatcgcggtatttgcatgcgcgcaggaagtgatggagcgcatgaaaaagctgctgactatccaaacgatcggctttgataaaatgaatatgctgcgtcacgcgcgttattttaagaatcttgacggtatcatggcgcacatggataaacaggcggagctgctgcgtccgaaatttaaaactgtgttggatgcgttcgaaagggagcttggcggcaagggcgtcgcggaatggatcaatccaaacggcggttatttcatctcgctcaatgtgatggatggctgcgcaaaacgcgttgtacagctttgcaaggacgctggcgttgtgctgacttcagcgggatcgacctatccgtatggggacgacccgcatgaccgtaacatccgtatcgcgccgacgtacccgtccataccggaacttgaatgtgcggtttcgctgctgtgtgtctgtacaaagctggcggcggttgaaaagctgttgcgttcataaggggagtaaagatcggaaaaccggcggatgattgttccaatcatccgccggttatgttatacttgtttcgttatattgtgccggcccgggcggccggagagggaaaggatgttgcaaaatggcgcgcgaccgttacgaaagcccgttctgcacccgctacgcaagcgaggagatgcagtatattttttcaaatgacaataagtttaaaacctggcgtaagctatggattgcgcttgcaaaagccgaacagcgccagggactgccgattacagacgcgcagattgccgaactggaggcgcatgcacaggatatcaattatgatgtagcccaggcgcgcgaaaaagaggtgcgtcatgatgtgatgagccatgtttacgcctacggcgtacagtgccctggtgcaaaggggatcatccatctcggtgcgacgagctgctatgtcggagataatacggatatcattgtaatgcgcgagggactgcgcgttatccggcgcaagctgatcaatgtaatcgcgctgctcgccggttttgcggataaatataaggatatgccggcgcttgcctatacgcatttgcagccggcgcagctaacgactgtcggcaaacgcgcgacgctttggatcaatgaattaatgatggatcttgaggagtgcgaacggcgcatcgcatcgctcaagctgcttggaagcaaagggacgacgggcacacaggcaagctttgtcgagctgtttgacggcgacggtgaaaagatcaaggcgattgaagccgatatcgccgaacagatggggtttgaagcggttgtgcctgtttccgggcagacctattcccgcaaggttgacagcctggtggtcaatgttttatcgggaatcgcacagagcgcggggaaattttcaaacgatctgcgcatccttgccaacttcaaggagatggaggagccgtttgaagcacatcagattggttcatcggccatgccgtacaagcgcaacccgatgcgcagcgaacgtattacggcgttggcgcgctatgttatgacggatgcgctcaatcctgccctgaccgcttcgacacagtggtttgaacgcacgctcgacgacagcgccaataaacgcattgcagtcgcggaggcgtttttggcgacagacgcgattttaaagcttatgctcaacgtctgcgacgggcttgtcgtatatccgaaggtggtgcgccagcgcgttatgcgcgaactgccattcatggcgacagaaaacatcatgatggacgctgtgcgccgcggcggcgaccggcaggagctgcatgagcgcctgcgcgtccattcgctcgccgcggccaggcgtgtcaaggaggagggggaagaaaacgatttgatcgaccggatttgcggagatccgtctttcagactcaagcgcgaggatgtagaggctgtgctggagccttcgcgttttacaggccgaagcgcgcagcaggtcgaagaatatctgagcagcgttgtgcgccccatgctcgatgaaaacagcggactgcttggagaacgcgcgcagctttccgtctaaagggagtaaaaggcgggcatactctgactggtgcgggcacacgtcctgccaaaaaatgaattgacttttggaaccgtatcccatataattaaaaaagtgtcgcattgcgcgggtccggattgatccgggggaaagcgcagcgcgcgtggcatcatgaaaccttggccggccggacagcaatcatcgtcccgccgacgcccgcagggcgcgggcttgggtttgcaaggaggacaagttaatgagaaaggttggaaaaccagtggttttcgtcgttgtggcgattatcattgttttcacgacattggcgttcttcggcatatcgacaagctacggcgatatcacaacgacctatatcaaaggcgttgacgatatccgttggggtatcgatatccgcgggggcgtcgacgtgacgtttacgccgcccgaaggatacgacgcgacgccggaggagatggccgccgcagaatccattatcaaagtacgcctggtgtcgcagaacatcacggattatgagacgtatgtcgacgaggcaaaggatcgcatcattgtccgctttccctggaaagagggcgaaacagactttaacccagagcaagcggtcaaagagcttggcgaaacggctttattgacattccgtgaaaaccagagcgggccggttgtgattgaaggaaagcatgtaaaatctgccagcgcggagccgtcgcccgacggccgcggctcccaggtcaagcttgagttgaccgacgagggcgcggaactgttctccgacgctacaggccggctgattggccagcagatttcgatttggatggatgacacgatgatttcggcaccgcgcgtcgacagccagatccccggcggtatcgcctatatcacaggcggtgcgcagggctttgatgtcaaggaggccaaggcgcttgccgaccgcatcaatggcggtgcgcttccctttaagcttgaaacggagaatttctccaccatttcaccgacgctcggcttcggcgcgcgcgatgcgatggtcacagccggcgtcatcgctttcgtgctcgttgcgatttttatcatcatcatgtaccgcatgtgcggcgtcgtcgcctctattgcgctcgtcggccaggtggcaggcatgatcgcctgtctgaccggcttctttgcgccgttcccgtcgtttacattgacgctgcccggtatcgccggcattatcctgtcgatcggtatgggcgtcgatgcgaacgtcatcacctccgaacgcattaaagaggaactgcgcaacggcaaaacgctcgacggtgcgatcgattccggtttccagcgtacattttccgcaatttttgacggcaatatcacgatggtgatcgtcgcaatcatcctgatgggggcgtttgggccgccgcagagcatctttaattcgcttctgtcgccgattttccgttggtttggtccgtccgcgaccggtgcgatttattcgttcggttttacattgatcgtcggcgtcatcttcaacttcattatgggcgtgaccgcatcaaggctgatgcttaagtcggtttcgaagttcaaaccgtttaagaagccctggctgtatggaggtgcgaaataatgaaacaggttgatatcgttggacgccggaaaatttggttttccatatcgtccgcgctgattgttttgattattgccgcctcgtttgtcttgggcgtcaagctggatatccaattcagcggcggtacaatcattacgtatacctttaccgggcaggcggataaggccagctttgaaaagacggtcgaggattcgctcggccagccggttacgctgcgcgagcagtatgatgtcaataccggtctgccgaattatatcattacgctgacaaataaatccggtatcacgccggatcagcagattgctgtgaatgaggcgcttcagacgcagtttcctgataacaatgtaaatgccgccagcattagcaatgtcgatccgacgatcgggcgcgacttcttcctcaaatcgatcgtcgcggttgtcgcggcgtcaattttgatgatcatctacattgctttccgcttccgcaaaatgaacggctggtcggcgggcgtaatcgcagtcatggcgctgctgcacgatctgatcatcgcttacggtgcgtttgtcatctgcggattcccgctcaatgacagctttatcgcagttatgctgacgattttaggctattcgatcaataacacgatcattgtctacgaccgtgttcgtgaaaaccgccgtctgctgcctgtcaagacgacgtataaggatctggttaatctttcggtcaatcagtcgatgacgcgttccatcaatacgacagtttcgacagtgattgcggttggatgtgtctgcgcgatgtcgctgatttatcatgtcaactccatcttgacattctcgctgccactgctggttggtatgtttgcgggcttcttctcctccatgtttatttccggtcccctttgggccttctggcaggagcgtaaacgcgcacagaaatcagcttcgtaacgaacgctcaatgagccgccggtttaccggcggctcatttggatagacgcgcatttatggcgcgtatggaataggatgctcataagcaggcggcaaaagccgctctgcctgaaggagggattcgccgtgttggcgggattatcgacggcatgcttttatccggaattgacggaacgcggccttatgtttgccgcatcgatcggcgcgcaggcggcggaggtctttttcaatgcgcccagtgagctgacggatagctttgtacgggaactgcgccggatcgccgatggctcgggcacgcgtattttatctgttcatccctttacatcaggccttgaaccgctgttgtttttttccggatacaggagacgcttttgcgatggggtagagctttataaacggtattttcatgcggcaaatttattgggagcgaatctgcttgtgctgcatggcgaccgtcgtatatctcaaaagccgcgttctgcatacttcgatgcatttggagagctggcgggagagggacgtgcaatgggtgtaaccgtcgcacaggaaaatgttccccgctgcgcgagctattgccctgatttttttcgcgatatgcgtcaatacctgccggacgcgcggtttgtgctcgatatcaaacaagctgtgcgcgcgggctatacgcccggcgagatggcccgggcaatgggatctggcgttgtccatctgcatgtgagcgatcacaacgcaaaaaacgactgcctgccgatcggaaccggcgattttgatttggctgctttactgcggcaggtgagaggcaacggctttgacggcggcgtaatcctggagctgtaccgggacagttatggggaatatgaggaattatcatcggcatatcaaaatatatgtgcagcgattgaaagcgcacttgaataaaacggcttgagtttgttttggttttgtggtatgctaactgcaggtattttcttacttttatggtccgctgtatgcggattcggttgaaagggagtgatccgcgtgaaatgcccttattgcggatatgttgaaagcaaggtgatcgattcgcggccgactgacgaatcggagcgcatccgcaggcggcgtgaatgcctcaaatgcgaacggcgctttacaacatatgaggtgatagagacgacgccgcttgttgtgatcaaaaaagataagtcgcgagagggctttgacagcggcaagctgcttgcagggcttgtgcgcgcgtgtgagaagcgccctgttccgcttggcattctggaggacgcggtacgggatatcgaaatgatgcttcacaattccctcgacaaggaggtgccgtcctatcggattggtgaactggcgatggaaaagctgcgtgcgatcgacgaggtagcctatgtgcgatttgcgtccgtatatcgtcagtttaaagatatcgattcgtttatgaaggagcttcaatcccttctggaagcgcgcgcgggacgtcaggagcaggaaacaaattgattgtacatagtataaaagcagccggaaacgtccccgtttacggctgctttttacagatcgtgttccgcctgcggctaaaggccggctttcctgattcaatcacggcagacaggatctaaaaaaatcgggaatttataaaaatcaggaagatgccatcaatccgcgaagttgtcaaaatacccttggatccatacaatcggcgttcctttatcgccacttccggacgttagatcgcatagactgccgatcaaatcagtcaggcggcgcggcgtagtaccctgcgtctccatggttcccttgaggtcggcgcgtttattgtgaatatattccgccattgcgtttttgagcgcctcgccggacaaatctttaaattgattgtcagccagatatttgagcttcagttcattcggaagcccctccaaaccgctcgtataagcgggactgacgaccgggtcggccagttcccatatttttccgacgggatcgcggaaagcgccgtcgccataaacgagcacctctatgcgtttgccggtcgcggagctgagtttttcctgaaccgatgtcacaaactgatcgcaatcgcgcgggaacaacttgacacgctcctcggtcgatttgttgctgccaagcaagccgtactcacagttgaagccactaccattgacaggcgcgcagaggatatcgtcaaggccgtataccgcctctcctccagcctgcgcgagcaggcgcttggtacgctgacgcgtgtggatatcgcagcaaaggatatgcttggtataggaaagaatggcggtcggtttgttggcaaaaagaatttcagcttcggcgccttcctccagaatcagtgacttataatattccacataatcgacgccggtaaatatatgcttattttctccgaacagcctacgatatttcgactcgtccagtacgtcggtccatggattgacagcggttgattcaagcttttcatcggaaatcagtgtgtttccaacctcatcgctcggataactgaacatcagtacgaccttttttgcgccgcgtgcaattccgcgcaggcaaatggcgaaacggttacggctgagaatgggaaagacaacgccgacaggatggtctccaaatttcgcacgcacatcggccgcgatgtcgtctacagaagcaaaattgttttgtgcttttgcaacgacagcttccgtaacgccaacgatatcgcggtcattgaaggcaataccgccgctttcggccgcttgaagcacacaatccgcgacgatctgcgcgaggtcgtcgcccggacgtatgatgggtgcacgaacgcctcgaaccgttgttccgatcattcttgacataagaaaatccctccgatggcggcacgccgccagtaatgtgctgtcacacagcacccaacatgacacagcggctctccccgccggaaagccgcctgcttcgtttattatacaggaacaacgaaaaaaatacaatatatgcgtatgggaattgttgaaaaatggtttgccttatggcatgatgccatgcatataggtagcggttgtattttgaatggcgccgttttcgtcgatggaaacaacggaccaatttcctttataaaagacggatttagaaagataacgctttgcaagtgcgggcgtggaaaatggtttggcaagagaaacatcctgcacaagcatacgtgtgttaaataggtattgcacaacaccgtcctgatagatttggatgatataatgcacggtgtaattgctcctttcagcaatcatagatatgttgtatatcatatcatttgaaagagcagaaagcaagcgatgcgtacacagggttttacaccggcttaattgtacagactttcggacaatgcgcgcaaacctctgcgtgcgtcaggctgcaaagcgttaaagaaaatggagaattgtttttgccaatcatacacattctgtacgcgcatccggttttcatcttcccatacagtaggaatcctggttaaaagcagcgcacaggtgaagtcatcaaaagaagcgtagacagatagaaattcttcctcaaaaatgcagtctgcggcgagcagatcacacaggtcatccaagctgcgaagctcggtgcgaatgattttgacacgctcgtcggcgtcgtcgcagagaaggacttctgataccaccgcagcaaacgcgtcgtcgctgaggcgttccccgccctgatagcaaaaacgaggcgattgcggctgtacagccagaaatgcggcaggagaaccgcctgccgcattcagcccattggaaaggcgcgcacaagcttgccacagataactgttcaagcgttcgttgtcaaaggcccattgtacgagaagcgactggaccgtgcctgcaatcaatttgccgcgttcctgcgcgtcaagcgcagtcagccgcctggtcaataaatttgcatccgcctctgaaagctcgacgccggttttccctagaatatggcagaatacggcgttctggaaagccagtgtgaacagattgacatatgcatccttgggtgtggtgcggttttgatacgaccaatcgcacagcagtccctccagatcgcccatgaagcggccgcagaaacggttttcaagcgcaagctgctctagacgatcccttacgccgatgataccgcctgacgcgcgttcatcagcaagcggatattccgtcataacaataaaattgcgtggaaagcgcgctgctttccaatcatgcacatattgaggcagggtgctgtcaagcagaatattgtatccttcgtttacggtttttgtacgtgtagcccgtacacgtgaaagcagccgttcgcaggcacgtgcatgatctgaaagaatcgcggcgcccatctgataaagctcgcccattgcctgatttttcaaaagggaaaggctgtcctccggcgatgaacaattctttaatgcaatatcgatacagtagccgatcccatccataagctgtgcggcggattcctctggaacagaggtgctttcaccatgtgttgcttgttcgatttgatcgtgcagaatgccaaaaagctgatcctgcatggtttggagggcttgtccgccgagcaggccgctcttgatcgcagcatgtgtcaaagaagcggtataatcgtccgggtcaagactggagacatcgattggcagcggcgttataagcgaatggtccgccatgttccatcctcctctacatcataatcgttgaatgcctgttcgctgacggggccttcggaaggggcgcacttggcgccatatgcacgaatattgtatgctatgcggtcaagctcgcggtcggcgagcaggtcaatcgagccttcgcaacagccgtcaaaagcctgcttcatttggtcgagcagctcctcgtccgttaaacggtcaagcgtatcagatttcataaagtaaaataattcggtcagacggcaaatgctctcgacataattttcctcattgatatagggggaatcacaaaatttttcaatcaaccggtcaaccgctcccgatccaatttcaatgcgtccactaccgcgcaaggcctgcgtgcgcgcgttgaggacggttacagcatcctcgtgcgtcaaggccagcccataggggcgggtgacatcgttgacctgcatcaaatggtcgatctcatgccgtgctggcgcagcgatgtgccgcccgagcagggaaagaagctcgctcataatctgtccccctgatcaaaaaaatttaaaaaacatattgacaaaaaccataaaatatgatataattaaatttaaaagaaactttcatcaaaaagataccacaaaccgcatgatttgtcaagaatttatgcggcgttttttaatgaaagaagcggtttaataaaaatgatcagtggaaacccgcccgccggcaattgccggcgggcgggtttagttatgattttggtcgatcagcgggagagtgtgtataaattgtatcggagggcaaggtatcaaaatttggaagctccgccttcattggaatattgatctcaagcgtttgcgtatcgtgcgtagctttgtccgcttgtgatttggattccggaaatttaccccatcttttgcctatcttagttgtcaaaatcaagatcaggtaaagcaccagcaaaataccaagaaaaccgaacaggaaccggatgaatacgccctttacatctgtctttggggcggtatagtttggataagcctgcggcggcaaatagggtgaaagcccggtttcatttgtataaagcgcgatgattgccgcttctgtggccgccacgtcggcttctccgccaggctcaggggaatagccgccgccggcggcgaatgcagagagcgcatccgtcagcgtgcgtccattcttaacgaaccgctgatcatcacaagcgacgccggctgtccgtattgccgtcagcacaagtgcagttgcttcgcaatcaggcgttgcctgtagggaaaaggttccatccgcgttttgctgggcagaaagccatgagagcgccttgtccagcgacgcgttgacatatggaatatcgatatgcggcgagagtgcaagtacagcctgggcggttgttttgacatccggctcgcgtccggatgcgattgcaaagcctccggaacgctgctgtgaggaaacaacatagtcgataacagctgacgccgaattgcgcgcggaagcggggatctgcgtattcgccgcatcgtaggagatcagagcatacagcgcgctttcgagtccttcacgaaaaatattgtcataaccataaagcatggacatcaggtcggtacgattatatgaggaaggattttcgccgagcttgatcaagcccagaatcgaatactccaattcaagggcagaggtaaatccgtccttcataccgctttccagtgtgatgtcaagcatctgccgtgcgttttccttgacatcgcgtccgccaagcgagtaggcgacgatgctttgagggcctgcgggattttcatcgaggtaaatccagctctcctgaccggccggggagacaggcggcagcggctcggagctttcggcaaagataacggtcgggaaaaaaaggatggcgcaggcggccgcggccgcaatccgtttgagcaacaaaagacactcccttttccggcctgccgcatgggacaggctttggatagatactttttaagtataatacaatatacggatgatttcaaccgccgcaggaaatacatttttgcccaaaataaagtttgaaagacgtaggcaattagagtataataaaaattgaatatagacgcaaaatggatgggagaggtggttttcttggctacaaaatttattgttcctctgcaaaagatcatcaaggattttaatcttgaggtgctctatgttccggaggacgccagtacgattgcaatttcctctccggaagtcaatcgtcccgggctgcagctttctggtttttttgattattttgacagtcagcgcgtacagatattgggaaaaagtgaatttgcgtttctgcagcagtttgacgacacggaaattacaaaccgaatagacaattatttttcaacctgtccgccggcggttgttatcacacgcaatattgaagcgccggcttgtatgatggatgcggccaaggcgcataaggtttctctgctgcgcacggctgacggcacgtccgcgtttatggcggggctgatcgccgaactcaatgtggagctggctccgcgggtgacgcgtcatggcgtgctggtagaggtttacggcgagggaatccttctgctgggtgaaagcggcgtcggcaagagcgaaacggccatcgagcttgtcaagcggggacatcgcctgatcgcggatgatgctgtcgaaatccgccgtgtttccgccaagacgcttgtcggttcttcaccggagaatatccgccactttatggagctgcgcggcgtcggcatcatcaacgcgcgccgcctgtttggaatcggcgccgtcaagatgacggagaaaattaatatgatcgttcagcttgaacagtgggatgcgaccaaggtctatgaccgcatggggatgaacgaggaatatacagatgtgctcggcgtgcaggtttcgtcgttgacgatccccgtaaagcccggccggaatcttgcgattatcattgaggtcgctgcgatgaacaaccgtcaaaagcgtatgggctacaacgctgcgcaggagcttttggaaaagctcggcatggtggagccggacagcacgcagacaacggactggggcgatttctgagaacgggaagggacagatatcatgcagatcattgcagagacgcattcacatacggtcgcgtgtgatcatgcatacagcactatttatgaaaatgtatgtcaggcggcgcgcgtcggattgaagtttttgtgtgtaacagagcacggacccgcgatgccgggagcgccgggcgagatgtattttgggaatatgcctaaggtggtgcctgattttctggagggtgttgcaatcctaaaaggcgtcgaatcgaatatccttgattactgtggccgtcttgatctgtcggagaaaaagctggcggcgctcgattgggttatcgcgtcctaccacatcaactgcgtggagccttccacgccggaggaacacactgccggatggcttgctgtcgcgaaaaatcctcatgtcgatgtaatcggccatgcgggcgacgaccggtaccgctttgatatcgatacagtggtgcgtgcgtttgcggaatatggtaagatcgtggaaatcaacgcgcactcattcgaatgtcggccaaaatcggatgtcaactgccgggagatcgcgcgctgctgcaagaagtatggcgttcgggttgtttgcagctccgatgcgcattttttcacacagatcgcgcgtgtggacgaatcgatcaagctgctgcgtgagctggattttccggaggaattgatcctcaatgcgaattatgaacggttcttagcggctgcgcgtgaaaagagcggccgcagcatattttaaagggagggctgaatgcatgggatattatgtgggaattgatctcggcggtacaaatgttgcggttggtattgttgacgaaaactataatattattggaagggcaaatgtgcgcacgaaagcgttccatcccgccggagagattgcagacgatatggccgctgctgcccatatggctgcggcgaacgccggtatttcgatggacgaagtcgtatgggtcggtgtcggtacccccggcaccgtcaatcccagaacaggcgttgttggtctggcggcaaatcttggttttcatgatacgccgctgggcgagttggtagctgaacgtgtcgataagcctgtttacgtcgaaaacgacgccaatgcggcggcttacggcgaattgaaggccggcgcggcgaaggggcttgattccgcaattatgatcacgctcggaaccggagtcggcggcggtattattatcgatgggaaaatctattccggttttaactataagggcgctgaacttggacatgtgggaatggtttatggcggcgtcccatgcacctgcggccgcatcggctgcatcgaggcgtattgctctgtttccgcgttgatcagaatgacgcgcgaatcaatgcagctcaacgccaaatcgaagatgtgggagcttgcgcagaacagtttggatcatgtcaacggacgtacagcctttgacgcgatgcgcgcaggggatgaggcagccagccgcgtggttgaccagtatatcgattatatagcctatgcggtcagcggaatgatcaacctgtttcagccgcaggcggttgtgatcggcggcgggatcagcaaggagggcgaaacgctgtttgggcctgtccgtgcgcgcgcctatccgcaaacctttaaccacgaggagcaaaactgcgccaggattttgcaggcaaaactgggcaatgacgccggcatcatcggcgcggcgctgcttggaaagcaatattgatttgggaggactgcatgaacgcaatcgcacagcttcgaaaggattgtgaacggatcggctgcatctgtctggcggatgagccgatggctgcgcacacgtcatttaaaatcggaggaccggccgacctgcttttaaaaccacgggatgcagaaacggcggcccgcgtcattgcgcgggcgcgggagctgtctgttccgctgttgtttatcggcaagggttccgacctgctgatctgtgacgaaggggtgcggggcgcggttttgtcatttgacgaggcgtccgcgcgtcccagtctgcgcgatgaaacggtgatagattgtccggccggcgcgagcttgacggcattgtgttgttttgcgctggagcagggattgacgggccttgaatttgcctatggaattccgggaagcgttggaggagccgtctatatgaatgcgggcgcttatggcggagaaatccgtgatgtggtagggtccgtccggtttcttgacgggcagggcaagctgcgtgcgctggaggagtgtgcgctggaattaagctaccggcacagctattttaccgatcacccggattgtctgattacaagcgcgtcctttcatctcaggcgcggcgaccgggatgcgatcagggcgcgtatggacgatctgatggagcggcgcagaacgaagcagccgttggaatatccaagcgccggcagtacctttaagcgtccgaagggcgcgtatgcgtccgcgctgatcgatggctgcggactcaagggccggcgtgtgggcggtgcgatggtcagtgagaaacacgcgggctttgtgatcaattatgacaatgcctcctgcacggatgttctgacgctgattggggagattcaaacacaggtgcgcgagcagacgggcttttcgctggaatgtgaagtcaagtacatcggatagcctatgatcatacagaaaggatgttgtatggaatttgtaattatcaccggcatgtccggctcggggaaatcccgcgcgatcgctgcgatggaggatatcggctattattgcgttgacaatctgccgccgcgcatggtcaaatcattcacagacttgtgcctgcaggccgcggataaggtcgacaaggttgcaattgtcattgatgcgcgcagccgtgagatcttcggagatatttttgagggaatcgaggagtttctggaagcgcccggcggatttcagcttatgtttcttgattgcgacgatgcggtgcttgtccagcgttataaggaaacgcgccgtaagcatccgctgatgaatgacaaaaatacgtcgattgaagcagccgttgctgaagaaaggcgtttgctctccaaagtgcgcgacaatgccaattatgtgattgatacgacgtatttatctgtgcgccagttacgtgacaagataatcgccacatttttaggcgataaaaagcgttccatgcttgtcaactgcatgtcgttcggcttcaagtacggcctgcccaaggagtccgatcttgtatttgatgtgcgttgtcttccaaacccgttttatgtcccggagcttaaggcgcatacagggcttgacgcgccggtgcgcgattttgtacttaaatgggaacaagcgcaggaattgattccgcggttgttttccctggtcgattacctgctgccgctgtacaatgatgaaggtaagacgcaattgacgattgcaattgggtgtacgggcggtaaacaccgttcggtgacatttgcacagcttctcggcgatcatatcaaggaacagggggtgcgctgtactgtaacgcaccgcgatattgaaaaaaacaaggactgagaaggtcatgtcgtttgcatatgaaatcaaaaatgaaatctgtcataacaggccgtttcgccagcgccgccaaaaggcgctggcgtacggcctgttgctgtttggcaagacgtttggaccggattccatatcgatccacacggagcaccggacgctcgcgcgcttatatgcggacagtatttctgatctggtcgggctgcgcgggagcatcactatgcgcgaggtgcgccgatccggccggcgcagcatatttgttgtgacagtcgacagcgtgacggaccggattgctgttctgtcattttttggatgccgtgccggcgaggactgctgccaaatccgcagggagctgctcgctgacgacgatatgcccgtctttatcagcggagcttttttggcgtgcggcacggtgacggatccggaaaaaagctaccaggcggaatttgtcacaccgcatcaagcgctctgcggcgagcttgaaacgctgctttcagagatgctttcgccgcctaaacgcacggagcgtcgcaacgactatgtgctctattacaaggaaagcgagcagatcgaggatctgctcacgctgattggcgcgccgaagtcgtcgcttgagctgatggaggttaaaatcgttaaggaggtgcgcaaccgcgtcaatcgaaagacaaattgtgagacggcaaacattacaaagactgttgaggcggcgcttgaacagatcgccgcgatccggctgattgaatccagctgcggcattcaggcgctcgacgaggatctgcgcgagcttgcgcgtctgcgcctggaaaatcctgatctgtcgctaagggagcttggacaagctttgcagaccccgatttcgcgcagcggcgtcaatcaccgcctgcgccgtatcctcatgttcgcgcaggagcttgggaaggcaactggaggagaatgaatcaatgattatgacaacaacgccgtttattgaaggcaggcgcattacagaatataaaggcgtcgtattcggcgaggtgatcgcaggcgtcgattttgtaaaggatttcacggccggactgagcaactttttcggcggccgttcgaacacctatgagcaggagcttatgcaggcgcgccaaacggcgctgaaagagctgtccgaccgggccgccgcactcggcgcggatgctgttgtcgggattgatatcgactatgagacgctcggttcaaataacgggatgctgatggtaacagcgtcggggacggctgtacgaattgaataatgaatgataggaaaagggggtctatgtgcggttatgacagattttgcacatctgcacgtgcatacggaatacagcctgcttgacggcgcgtgccgcatcgaacggctgatcgagcgtgttaaggcgcttggacagagcgccgtggccattacggaccatggcgtgatgtttggcgctgtcgatttctataaatgtgcgaaaaagcacggcgtcaagccaatcatcggatgcgaggtctatgtcgcgccgcgctctcgttttgataagcagcataagatcgatacgtcgccgtatcacctgattttgctgtgcaaaaatgaaactggttatcaaaacctgattaagatggtgtcagccggttttgtggagggcttttactctaagccgcgcatcgaccgcgcactgcttgaacagtatcacgagggattgatctgtctgtcggcctgtctggcaggcgagatcccgcggatgcttgcgcagggcgattatgcgtgtgcgaaggaaacggcggtttggtatcgtgatctgttcggcgctgacaactattacattgaaattcaaaaccatggcatccggctacagcagcagatccttccggatttggtgcgtctggctggggaaatcggcgttgggcttgtcgcgacgaacgacgcgcattatattgaaaaggccgacgcgaggatgcagagcgttttgatctgtatccagacgaacacgactgttgacgcgcccggtgatcttgagtttgaaacagaggaattttatattaaaagccgcgatgagatggacgagctgttcggaaattatccgggcgcgcttgacaacacgctgaagatcgctgaacagtgcaatgttgaatttgaatttggcaatacaaaactcccgctgtttgtcgcgccaaatggcgaggacaatcaggcgtatttcaggcggctgtgcgccgaggggctgcgccgccgctacggggaacagccggaccggagcgttaccgagcgtctggaatatgagctgaatatcatcacaaagatggggtatgtcgattattatctgattgtttccgattttatcaattacgcaaaatcggttggcatcccggttggacctgggcgcggctccggcgcaggaagccttgcggcgtactgtatcggcatcacaggcatcgatcctctgcgctacagcctgctgtttgaacgctttctcaatccggaacgcatcagtatgcctgattttgatatcgacttctgttatgaacgcaggcaggaggtgatcgactatgtggtgcgcaaatacggcgccgaccatgtggcgcagatcatcaccttcggcacaatggccgcacgcggcgcaatccgcgatgtggggcgtgttcttggcatgtcgtatcagcaggtcgactcaattgcaaagcttgtgccgaatgaattgaagatgacgctggataaggcgctcgctgtttccgccgatctcaagacgatgtgcgctgaggacaagcgggttgcggaactgcttgatatggcgcgcaagatcgaggggatgccgcgccacgcgtcgacacacgcggccggcgtcgtaatcacccgcgatccggtggacagctacgtgccgctttataaggcggaggaaacgatgcctgtcacacagtttacaatgacgacgcttgaggagcttggactgctcaaaatggattttctcggcctgcgcacgctgacggtcatcagctacgccgaaaaagaggcggccaaaacacatcccggattctctgcggacgcggtgccgctcgacgatccggaaaccttcgccatgctgacaaagggacagtgcgttggggtgttccagttcgaatctgcgggaatgcgcgccgtcatcgcacagcttggccccacctccatcgaagatttgatcgccgtcatttcgctttaccggcccggtccaatggaatcgattccgacctacatccgaaaccgccacaacccggaacttgtcacctataagcacccgctgctcaagccgatcctggatgtcacatacggttgtatcgtctatcaggaacaggtcatgcagatctgccgggcgctcggcggctattcgtatggacgcgccgatttggtacgccgcgccatgtctaagaaaaaacacgacgtgatggagaaggagcgcgaagcgtttgtcgccggcgcgcagcaaaacggtgtggcgcgcgagacagccaatcagatttttgacgagatgagttcgtttgcgtcctacgcgttcaataaatcgcacgcggcggcttatgcgtttgtttcctaccagacggcatacctcaagtgccactatccgcgcgaatttatggcggcgcttctgacaagcgtgcttgacaatactgacaaggtgattgaatacatcggcgaatgtaatcgcatgggaattaaggtgcttccccctgatgtgaatgtcagcgtcgagggcttcacagtcagcggtgaagaaatccggtttggcctgctggcggtcaaaaatataggccgcggctttatccgtgaattgatcgccgagcgcgaaagcgggggagtattccaaaacttttccgatttctgtgaacgtatgtatggaaaagatatgaataagcgcgctgttgaaagtctcatcaaatcgggcgcgcttgattgcgtatgtaaaaatcgcaaccagatgttgtcaggttacgaggcaattctggacgatattgactctgcgcagaaacgaaatatagccggccaaatcaatctgtttgatacggcggcaggcgcttctaagccaattcatatccttccaaacgtggaggagctggagccgtcgaagcttctggcgatggagaaggagacgacagggctttatatcagcggtcatccgatggcacgttttcaggagatggtgtcaaaaaacaattgtacgctgatcgccgacatcacttcggcggaggagcgcggcagcggtgtggctgacggcacacaggtgcgggtagccgcgatcgtaaacagccgccggcttaaatcgacgcgcggcggtgagatgatggcgtttgtacgcttggaggatacgagcggcagtatggaaatgctggtgtttccaaaggtgctggcgcagtgctcgcagaagctcgtggaaggaagtgtcgtgcttgtcgcggcgcgcgtctcagtgcgcgaggaggaggaagcgaaactcatctgtgagggcgcgtcccttccgggagaggagccgcccgctttaggacggggcggcgcgcgcgtgcaggcacaggcgcccagcacaaaaccaagtaagaacgccggcgtctatcttcgtgttgagagcagcggcgcacctgtgtttgcgcgtgttaaaaatctgctttccatctttgcgccggagcgcagcttggaaccatgcgataccgtttatttttactttatggatactaaaacatataatgtagcttcccggacgctatgcgttttctggaaccccgtcctggagcgcgagctgaaaaaactgcttggcgaggagaatgtcgtttaccgtgcgtaaaggaaataccttgggcgggatagatgaaaaattcccatatgtctacaaaattattctctaaaatgaaaaatttgcatgcgattatataaaattgcttgaactgacgcggggaatcctctataatgagaaacgttgaactatagaaatgcgggggattcccccagacggaggatgcagcgatatggagtttaaacagaaaacaatcggtgtactcagcagcggcggcgatgcccccggcatgaatgcggcgatccgttctgtcgtcagaactgctctgaaccggaacatacgcgtgcttggaatccgccgcgggtacagcggcctgctggcgcgcgatatgtttgaaatgaatctgcgcagcgtcagtgatacgctgcaccgcggcggtacaatcctgtattcggcgcgttgtccggaatttcgcgacgataagggtgtcgaacgcggcaaagaggtctgcctcgagatgggaattgacggcttggttgtcattggcggcgacggctcgttccgcggcgcgcgggatttatctttgaaagggattccttgtatcggtattccgggcacaatcgacaacgatattgcttcgagcgattatacggtcggctttgatacggcggtcaatacggttatggacatggttgataagctgcgcgacacctctcagtcacatgaccgttgctcaatcgtcgaggtgatggggcgccgctgcggcgacatcgcgcttcatgccggtatcgcatgcggcgcggttgcaatcctggtgccggaggtaccgttctcaatcgattcaatcatcgaaaaaatgcagcgaaccctgcgcaccggtaaaaagcattttattattatcgtagccgaaggtgtaaccagtgtcggcggagtcggtacggtgcatgatattgccgaggaaattgaggcgcgtacaggtgttgaatcacgtgcgaccgtactgggccatgtacagcgcggcggcgcgccgtccgcgcgggagcgcgtgctggccagcgagatggggtatcacgccgtcgaattgcttgaacaggggatcggcaaccgtgtggttgtcaatcatgacaataaaattgtcgattatgatattcttgaagctctccagatgaaaaagcagtttgaccgtcatctgtatgatattgcggatgcaatttcgatttgattgcgctttatgcagcccccgcttcacagcgggggtgtttttctgcttgaaatgcacgattatttttatcctttgggagataaaatctccatgatacagcattttttcacggaatggacatgataaaataaatgcaaaggcatttattttatcccttatggtcagggcgatacgcgggcgcggcccgctgaaagcgattaaatcatatccgcaaagcgttatgtttcaatcgggagctacatggacttgttattaagcagtttgcgttcatgctgcgggacgccaaaacgggaaggaggaagaagcttatgctgctttggagaaaaggcggtcaagagcaaaccggtgagatcgatgtgaaaaggccatatgttgcggctgtggttgttgcagccgggacgtcgtcgcgtatgcaggggcttgacaaacaattggaggaagttggcggcataccggtgatcgtgcggacgctgctcgctctttcagacagcgattggattgatgagatcgtgcttgtcacacggcgcggcacaataccggacatgcttgctctggcgcgtgcatggggcgtgccgaaaatccgttctgttatcgccggcgggcaaacgcgtcaacagtcggttcaacttggcgtcgaagcggtcgggccgcaggcaaggtatgtggcggttcacgacggcgcacgtccgtttgtatgtgggcaggtgatcgctgacgctgtgttcgacgccatccgatatggcgcagcggcgcctgctgttccggtcagcgatacgatcaaggtggcggatgcaaacggtatgattgaatcgaccccggatcgcagccgtcttttcgcggttcaaacgcctcaggtattcgaactggaacgttaccgcacggcggcgcaggccgcattgcaaagcggacacgattatacagacgattgccagatgcttgaagcggccggatttccagtacacttgtcacgtggggacagcgataacattaaaatcacgacgccggtggatcttttggctgcgcaggcgattgcaaagctgcgggaggagatggaggcatgaagctgcgcattggacatggttatgatgcgcacaggtttgcagataaccgcagactgatcattggtgggattgaaattccgcatacacgcgggttagatggtcattcagacgcggacgtactgacgcatgccgtgatggacgcattgcttggtgcgctggcgctcggtgatattggaagcttatttccggacagtgatcccgcgtatgcaggtgctgattcggttgccctgcttgtgcgtgtggcagatttaataagtgcgcaaggatggcgcgttggcaatattgacgcgacagttattgcacaggcgccaaaaatcaagccttacatagaacagatgcgtgcacgtatcgccaaagcctgtggagcgcggccggaggacgtcagcgtgaaggcgacgactgaggagcatatgggctttacaggtcgtgaggaggggatccgtgcgcacgctgtctgcctgctggaacggagcggatgaccaccttgtgcgtgcctgcataagatgatacagcggtatgtctgccatgccgctgtattttgttatgttgggagagcttttaatggcaatagaaaattccattttggttgtacgctcgatcacctatgcaatgaagggccagaagcttttggaaagcaacggaatttcggcatatgtggagcgcaatccgttcccaaacagccgtgaaggctgcggatatggcctgcgagtgcagggggatgtatcgcgtgcggtttccatcctggaggcggcaggggtgaaaatctccgaaataaaaagggggaagccccaatgatttattttgataatgccgctacgacctttccaaaaccgcttgtcgtaaagaatgctgttgatactgcattgacacgttatggtgcgaatccgggacgcggaggacatgacctttcggttgaaacggcaaagcaggtatttgaagtgcgctccaagatcgcaggttttttcggcgcgaaggacgttgaggacgtggtgttcacacagaattgtacctatgcgctcaatacagtgatcaaagggcttctgcgctttggcgaccatgtaattatttccgatcttgagcataattccgtgctgcgccctgtgcatacgcttgcaacacgcggtataatcacttatagttcggcgtgcgtttcttttgacagcgatcagaccgtagcgtcctttcgctctctgatccgccccaacacacgcgcgatcattgtaacgcatgcttcgaatgtgttcggaacaattttgcccatcacacagcttgcgcagttggctcgtcaatatgggttgtatctggttgttgacgcagcccagacagcaggaacagaaccgattgatatgcagaagatggggattgattttctctgtgcagcgggtcataaggggctgtatggaccgtctggaaccggatttttaataacatcctatggaaaacggcttctgccgctcgccgagggaggaaccggcagcgcatcctttgattatgaccagccggattttatgccggatcgcttcgaatcaggtacgctgaacacggtcggaatcctggggcttggcgctggcatcgattttgtttcatcatgcgggatggaacggattgctcgcggcgagctttacatcacacgctgtatctatgatgagttaaaggaaattaaaggcgtaaagctttacacacctgcgccgcagtatggaaccagttcggctgtgttaagctttaatatcgatggtttgtcgtcagaggagacaaccgccaagctcaattcagctggctttgctctacgcggcggactgcactgtgcgccagatgcgcataaaaaatatggaacaatcgaaggcggaacggcgcgcttgagtatcggcgcgtttaacacggtggaacagggcgcggccttttccgaagctgttcgccggattgtggcggcccaatagagaaaatatggctgccaaaaaaagattgatttactgcggatatgtgataaaataaacgcagggcgtttattttatcctttatggccggggcgatacgcgggcgcggcccgctgccgccctgacggccaattttatcatgccgcggcgcggacatgataaaataaacgcaggacatctatttaatcctttatggccggggcgaagcgcgggcgcggcccgctgccgtcctgacggccagttttattatgtccgcagtacggcatgataaaatatataaggaaacatgcggccgcatgtttggaacagcagaaaggaaatgaacgtatggccgagctttggtacaatatcgcggagacgttcagcacgatcaactggcgtgatgtgttggacatcctgatcatgacatttttgatctatcagggcatcaagcttgtccgtgagacgcgcgctgcccagcttgtcaaagggatcgcgctgctgcttgtcctatatttgctgtcggaagtactagagatgcgtgcgatgcagttcattacacagaatatcttgcagatcggtgtgcttgcccttgtcatcgtgtttcagccggagctgcgccgcgcgcttgagcaggttggccgttcacgtattggaaaattacaggttttttcatccagcgtcaacgaacaggaggaacgcgcaaaatggacaaaatttatagacgcgcttgttggtgaggcggcttcgctatcgcgccagaagatcggtgcgcttgtagtcattgagcagaaaacgaagctcggcgatattattaaaacaggaacgatcatcgattccgatccgtctgcggaactgatcggaaatgtctttttccccaattcgccgctgcacgacggcgccatgatcgttcgcgatggccgactgcatgcagccggatgttttttaccgctttccgataatcaggagatcagccgggagcttggtacgcgtcatcgtgcggcgctcggcatgagcgaaatgagcgatgcgattgtcgtcgttgtttcagaggaaacagggtttattacgatttgtcgcaacggccggcttgatcgcggcctgtctttggagcgtctgcgggaatatttgacggcggaattgacgccggaaaagactccggatcagtccgaacggttgttggatcgcctcatccccaaaaaggcgagcagcgcacaggaggatgagaagcatgaagattaattttggccgtttgcttgacaataaaaatctgatgaagttgttgtcgcttgtgcttgcagtggcgatttggcttgtaatcgttatttatgtatcgccgatttcacgcaaaactgtacacgatgttccggtttccgtttctcaggacgacagtgatgtgctcaattcgatggggttgtttgttgttgacaacgagactgcgactgttgatgtcaaaatccgggctgaacgccttgtactcagttccgtagctgcgtccgatatcgatatcgtcgcaaatctttccggcattacagcgccagggacgtatgatgtggcgcttgttggcggcgtgacgagcaattacaatcggggcgaccgctatggaaagggattcgagcttgacggaagcgatgcaatcagccctggaacagtacgtatccgtgtcgaccgggaggcgcgcgaaacgttccagattgttactgatatcgatggcctgtcctccccggaggaatattaccgtgatgaaccgcttgtcagccccaaggaggttacaatcagcggcccggaagccgatatcaaccgcattgatcgatgcgtggtttccgcttcattttctgagccgctgacatccagcaagacggttacaagtgagatcatgctatatgacgcagagggtaatgagatttcaaaggagcatctgacccttggcgtcgagacggcggacattacggtgccggtctataaaaagaaggagcttccgctcaactatgagtacattaacacgccgcgcgatttcccaattgaccggcttgaggagcggtattctgtcgcaagcgttctggtggccggccccgaaacgctgatagattcctacgatgtgctggaccttggttttatcaacctcagcgagatcacgcctgataatcatctgttcccattcccgcttgacggaaacgacggaattctcccgcgcggtttccgcaatctttcgggagtcgatacggtatgggttgagattttgacggacgggatgctggaagccaattttacaatcccggctgaaaatatcaaatcgacaaatgtaccgatcaattacaaggtaaccatccagtcaacaagcattcccaatgtgcatatggtcggcgacccggatgatatggctgcgttgacaaacacagacttggtggcggagattgatatgacctcaaaggaggtttcgcccggcacgtatctggagatgccggttcgtatctcggcgcccggcaaaggacttgtctgggcaaccggcgaatataaggcgattgtgactgtgacggaaaaataaaacgcggggcgcccggctttccgggcgcccttgtgcttcaaaaggaggaaaatatggcgatcatcgtcaattcgatcatcacctctctgacagaggaccggcaggaagccatccgaaaggcagtcggcatactggaagtccctgagccgcttgttcagagcgcatatatcgcaaagacatcgcttgacgcgcgccggcgcggcgatattcggtttgtacattccgtctcggtgacgctcgcggatggggaagcgcgtgtggcggagcgggcgcaggctaagggaaaaaaggttgttctgcgcgtggaggaacctctggaagcggcgttcggaccgggaaaactcagtcaccggccagtgatcgcaggctttgggccggcgggtatgttcgccgggcttctgcttgcgaaaaacggatacgcgccgctgattttggaacgcggcggagatatggacagccgcgttgccagtgtggaacggttttggagcggcggttcgcttgatcctgaaacaaacgtacagtttggcgagggcggcgccggcaccttttcagatggtaagctgacgacccggatcggcgatccgaagtgcgcgtgggtgctccgggaatttgtccgcttcggcgcgccggaggagatccttcacagggccaagccgcacatcgggacggaccgcctgcgcagcgtcgtaaaaagactgcgcgccgagatcgaatcactcggcggagaagtccgtttttacatgccggcatccgatttgatactcgaaaacggccgcctgtgcgccgtccggacaacgcagggggatgttccagccgacgttttgatcctggcggcgggacacagcgcgcgcgatacatttgaaatgcttttgcggcgcggattggtattacagcccaaaccgttttctgttggcgtgcgcgtcgaacatctgcaaagtgagatcgaccgcggcctgtacggcaaatatgcgggccacccggcattgccggtcggcgagtaccagttgtcataccgtacaggcgagggacgcggcgtatatacgttttgtatgtgtcccggcggagtggttgtaccggccgcttcacaggaagggatggttgttacaaatgggatgagtgattttgcgcgcgatggaacaaatgcgaacgctgcattggccgtctccgtgacgccggatgattttggtacggctccactcgatggtatgcgctttcagcaggagcttgagcggcgcgcctttacggcgggcggccgtggatacggcgcgccggcgcaggatgcaaagagctttctggaaggaaagacgggacttcacatcggccgtgtggaaccgacgtatgcgcgcggcgtctgtggctgcgatttcggcgccctgtttcctggttttgtaacagagatgctcaaaacgggcctgcggacctttggccgcaaattgccagggtttgacgccgcggatacgcttctgacgggtgtggagacgcgtacctcgtcgccggtacgtataccgcgcggtatggatttttatgcgcccaatgcggcgggagtgatcccatgcggcgagggcgccggatatgcgggcggcattatgagcgcagccgtggatggcctgcgcgcggcgcttgcgcttatggcggtatatggccggccggctccgcgctgatggtcaaaggacgaagctgcggcatacgatggtaatatccgccgggcctgttcaggagtctgctttgtatcttccgcgacaaatcttcacattgaaaaattccaagagtcaggatgcgaaacagattcaaagccgtccggcggacagtctgatgaatggggctgctgcgtacggtttggccggatgtacggcatggcccaaggaggtccgccatgaaaatcggcgtcgcattttcagggagcggtgcgtgcgcggcggccgcgcatcaatttgccgcactcctgcaaaagcgttctatagaaatcacgatgctgtcagcgacttcactggcggcagtaccatcgttgctctggtcgcgcggggtacctttggaggaaatagataaacagatgcatctgttttgcagtgtttcgccgcaaacagggctgcgtcaacttgaaaaagcggggttgttagatcgtccggcagtttgtgattttgcggtcaactgtgtagatgtgtcgaccggcgtgactgttatttattcagattcactacattccaatgcgtggaatcttaaggttctgccgcttgtgggaaatgaacgggctgcgcttttggccgcgctctgtccgtggggagatgctgaacccgtcgctttggagggaatgcgcctgtgtgatttttccgcttgctacggcagcccgttgttcccgctgaagatggcgggaatggaacggctgatggccgtgtcatttccgggaggtggtacgcccgcgcagaccgcggccaatagccttgtctgcctgacgggaaaaaatgcggacttttactgcgaggtacgcccggatccaaaccgccctgtatccgaagctgtacgcgctgcggttatgcagagtgccgccgtatttggtgaaaagctgcgactgtgagacggatgcttggatttgcaggaaaactgtgctatgatggataaaaatacggctatgagcgcctgttcgttctctctttggagcggatgatcaggcgccggaagctgtgccgctcagcggcacagcgcgccggaggagaggacaggctgatgatggaaaaagtaacgctgatgtgtccctgcctgtttggcttggaaagcgtattgtcgtttgaggtcaagaagttgggcggagagaatattgtggtgacagatggccgtgttacctttgacggggatctttcgatggttgcaaaggccaatatctggctgcgcacagccgagcgcgtcggaattgtgatagggagctttcgggcggagacattcactgagctgtttgaccagaccgctgagctgccctgggagcagtttattggggaggacgattgctttcccgtcaaaggctggtcagtcaattcgaagcttttcagcatgtcggactgtcagaggatcatcaaacgcgctgttgtccggcgctttgaaaacgtataccacaaaacattgtttgcggaaacaggcgcgctctaccaaattcaatattcaatccataaggaccaggtgacgcttttgcttgacacaagtggtccgggcctgcataaacgcggttatcgcgccaatgcgaacgatgcgccgattaaagagacgcttgcggcaggcattgtcgatcttgcgcgcgtgcggggcgattcgcttgtatttgacccaatgtgcggttccgggacgctcgtgattgaatcggcgctgcgtgcgctcaatatcgcgccggggatccggcggcgttttgccgcgcaggggtggcggtgctttcaaaacgggctgttcgatgaggcgcggcgcgacgcggcctcccaggtacggcgcgacgcgccctttgaggcattcgcctccgatatcgatccggaggcagtgcgcctgacgcgtgaaaatgcggcaaaagccggcgtggccgggcggattcatgtcgtacaggccgatgtcgcggattttgcgccgcagctccctgagggacgaagcggtattgtactggctaacccgccgtatggagagcgtatgctcggcgaacaggaggcgcaggcgttgtctcgtacgcttggcgcttcctttccgaagcgtgacggcttcagctattacatcatcagcccggatgacggctttgaggatctgtttgggcgtcctgccgcgcgccgccgcaagctgtataacggtatgattaaatgccaggtatacatgtattttgataagccggtccattttaaaaataataaatagctgcgcaatctataaaaaatgcggccgttttcatggtgaaaacggccgcatttttttgtttacgcacattttaagcctgtcagacatacatttatttatatgcaagcgatggaagggggcggcgcccgtgccgattacaatccgtgtcagcaaacgtaaactgcgcgcatggaagatgctgctgacgggggcggcgattttggcaggcgcgctattattgggcggacgtgtgcggccggcgattacctctgtctttacttatcaggcgcagttagccgcgacgcgctccgtcaatgacgcggtgctcgacgtgatcggacgcggcggtgttgactaccagtcgattatccatgtgcgcgaggacgcacaggggcgcgttacttttcttgaaacggatatgacggctgtaaaccgcctgaaagcggagattacaaacgccgtgtccgaccgtttgaatttggatgcgcaaagcggcgtccaaataccgatcggcacattgcttggaggacagttcctttcgggacgcgggccggacgtgacgttccgggtcattccgcagggatatgcaaaaacggatttctataatgcgtttcaggaagcgggtatcaaccaaacgctgcatcagatcatgctgcgtgtggaggtgccggtgagcgccgtcatgccgacgtatactgtggatacagttgtgtccacagaggtatgcgtggcggaaactgtaattgtcggagatgtaccgcagtcgttcacggaaatttcaggcgatcaccgcggtctgcttgataaggccggcgactatgccctcaaaagcagtggattgcctgagaaaaatgtgatacaataaaaacaaaaaggcggcaaaccttgatatttagcgggttcgttccttattttgttactaatttgttactagttcaatgttcaactggatataatatttaaattaattaagcctattgactttccagcagccctgaattatactaaacatagaaagagggtgctaccggcaaacggttggttccccctactggattacagaagtaaccgcatgcttagagggtggcggttacttctttttatttgcctgaaaaaacagggaaataatgccaacgattaaaatacctgtctgaatcagatcagaatatgtaaccatttgacagcccccctttctaaaaagatcagggggcaagaagcgcccctgaccagatcaggggaactaaccgcttgccgtttatcggtagcaccacaaacagaatagcacagcatttgacaaaattcaagggcttactgaatcagctcaatattcaatttcaattcctcaatatttttatgggtgtaaacccgctctcccgtccctctcgatttatgtcccatgattcggtcaatacaaaccttgtttgccccggccgaatcaaggcggctcctgaatgtgtggcggcactcgtgtggtgtgtgttgcatttctagcatctccatgatttcagcccacaaagccctatagtgggtttgtttcagctttttcccattgtattcaaacagatagccgcttttggactgtctggctcgttttcggactatgtgctgtattttcgaatgaatagggacgattctatttttccccgccgccgtttttgttcccccttgcatcgtgcccatatcaaaatcaacagcggaaacttgcagctcaatcatttctgaaattctgaaacctgtgtaaaggaagaacagaattgaatcagcccacggaaaattttgatttttccaaagccgggaaacttcttcatccgtgaaaattttcttgctcgtttctggtattggctcggaagtaagcaggtcggaatagcactttgatataatatcaagttccattgcgaagcggtcaagatgcccaaaaaggtttttaattgccccttgtgtagagtatccacggccgcagctatcaatgcactcctgcatttggtatgatctgatttgtctgtatctcagcttgtttagtttggaacagtgtatatatgccgctttcagggaaaccctgtttgcatcgcccaatttaacagcccgcttttcgagccacagctcataaagctcctgaaaagtgattttctctgtttcgatatcccacgggtcgttgttgtaattagcaagcatcataagcccttcttcccgtgtggcggcgtagcctatgggcttttgcctgccggataggccttccttcacaatgtagggctttcgtctgtttccagacagcttcgttactgtcccgaaatgatttggatttttcacaacttcaccgccattaacttgtaaaatcgggcgtgaagtgatataatataaatgacctggagaaatcattcataatcacttcatccgtttttgtgattgattggtcgctatcccccgctagtgttgcagcactggcgggggaatttttggttttcaaagttttcttaaatatttcactcagtcctaaaaaaaaggggggattgttccgcctgaccgtctccggtgtgcccccgacaggaacggattttttattatgctgttaccaaatcgtgcctatcggcatgatctggttcctgggcctcaagacggagagtttctctgtattcaattgcatcaggaatatcaataaaccttactgtagcattgtgatttttaagtacaactttttttatttcttcaagatcgacccggaaaaattcttttcgtggattgactttgttgatacgcttggaatcaaaatattgatgcaggactgtttcaaggccaggtgcatcatcagaaaaaatcatcgcgtggacatcaaagggaaagggaactgatgcgctgctcaattcagaaatcctgtccataggttccaaccggcgagtcatgccgattttgtaggcctgatctccgaaggaaccaatattagagataatgtaaacaaagcctgctcgtgtattttgttcacgatcaaagacatttttcttatcaacctctaattgttttatccgttcttgcagttcattgattttatcgatataaagttgacgttcggccgaatcctgtgatttttgcatgtaggacattaatttctttacttcattattgaattgagtttcttccttttcgatttttgctttttcgcgttcgatctcacgccgcaccttttcttcttcgaccatttgttcacgtatggctttgcgctgctctttttcttcatcctctttgagcatgtaagcatagatcagacttagctcttgaagtttcagactaagatacgaatcagaaatttgcacgccgtctgacgaaaagattttattgatggccgaaaaggattgctgaattttggcgcgagaagcgtccacgttttttacggttacgcccccaagtatgccaacgcactctgcgttgaagcagcggagaatttgcttgatttgtgtattgataaactttttctgaaattctgtatttgtaatttcgaccgcgtcgccattttttaagagagcatcctgctgactgcgcaaaataaccagttcattcttgatctcatctgatttcatattttgataattgtcgattcgaacagagcctaaaaggacatcaagttcaagtgacttgacttcggatgacagttctttacgctgttgggttaacgcttctatctttctttcaagggtcgctattttggcacttgccgcagaaaatgcttgatcagcttcggcttgtttattttccgcatagaaatcagcctctgtatgttttgcggctgcataagcgtcaatatcaaatacggcctccgaaatcgctgacatttccttaagttttttctttaaccgtaaatatgaccgtaatataataaagaaagcaattggaaatccgaaaatgaatataaccgctacaataattgatcccatcttttgtgtctcctctcatattgtctggatagaaattcctcttgaagaaatataatacaagtattacaatagacttaccggaataaaatggggcgcccccgatacgggaaaggagaaagattatgcgacggtgttgaaaaagtagttccccttgaaaacattcgggagaaaatccaagctcttttagagttagcggatgacaggcagctaaacataatttatcagtttgtaaaatccataacggagaaaggctgaaccgaaaggttcagtctttttttattcctgcaaccatacgttctagcacctcccaatcagattctttcaagcgtgccagcatagaaataaaacgctttttaaaggaatctgtttccttagcaagcgcaccgccaatgaaagctgcaatttcctcgtctcttgtcatttgtaagaatatttcgccctcgccagtacgtaaccaccgctcatttacgttaaactctttacaaatcaaggagatagccgcgtcacttggctcactgcgccccaattcatatgtcgcaaccgtatttctttttacctttattctgtctgcgaattcttgttgtgtcaaatccaagagacggcggatttgctttatacgctcattcagcgtgggtcacctccttatttccaaataaaagcatagcataatgatgttttattgtcaacaaaaagtcggtgaaaaacaaaaatagcttgacaattgttttaaacaaacatataatagttttagaatcaacacataaagaggtggataaaatgtcagacaaagagcgtgagattctggatgtgtttaagaaactcgtaccagttcttaccgattttgaaaaagaaaaactactggcgtttggcgaaggaatggctttcaaggccgcgcaacagcaggagggcgatacacccatagaccgcacagcgtaggagggaaacggatatgaccgatctagtgttcctagaacccgacaagctggattcggaaccgttcacaacctcaaaggtggtcgcggaatgtgcaaatattcggcaccatacagtaacgaagcttattcagaaacacaaaacagattttgaggaattcggaatacttcgatttaaaatcgaagaaatcaaaggacggggccaacctgaaaaaagctaccaactgaacgagcagcaggcgacattgcttatcacctatcttaaaaacacgccgccggttcggcagtttaaccgctacacaaacaaaggggccgtgctgaatggtacagcccctttgctgtaattagatatctgtatcggttgatttcattttggattgagtatcaagcaaatcctttgcagttttgattaggtaatcttgaagaacgggagaaagttcatcaaatatatcaaagaactctttctgtttcctgtcattttcgaggaacatctttccagaaccagtccgaagccagttctcattgacactgaattgggagcaaatagtcttgatattctgttctgtgacagtagaaccacttttttccatgtggcttatggcgttttgcttcaaacctattttttctgcaaactccttttggctgaggtcaagtgtttttcttaattcacggatacgcttattcattatcagcacctccaaaaccataatatcaataaatgataaaaaagtcaagaaaaatatcaaaaacgtattgacaaaaatcaatagttgatgtattcttataccggaaaatcaattaaagataaaaagaaaggggaatttatcaatggcaagtagaagctctgatatgcaggctatttttagcgaactctcggaaaagaacaaagacattgttattctgattgccaaaagcgtaaaggtcgcacaagaaacatctgaaaagccccgcaagccgccagtaaatcgcacagcgtaggagggagacggatatgaccgatctagtgttcctagaacctaacaagctaggttcagagccttttacgacatcggatatcattgccgattgcgcacaagtaaagcatgatactgtacagcatctgtgcaggacgcatcgaacggaccttgaggaatttgggaagctcggatttgaaatccgacctttgccaagcagccgtacagggcagagcacgaaactctaccgccttaacgaacagcaggcgacgttgcttatcacctatcttaaaaacacgccgccggttcggcagtttaaccgctacacaaacaaaggggccgtgctgaatggtacagcccctttgctgtagatcaggttttatcctgaagttcggataacttttttatctgctctaaagcatagtcttgaaaatctggattcaatgtctcgaatatttccattgcttcattgagtttggaagattttggactatctgcttctctctcagttgaaaaccctgtttcaaggagcacatcgccagaagtatttagagcgcaagccagcagttttattttcgcaacatcaggttgtcgcttaccagtttcataaccgcagtatgtgctattggttatccctaataaatcagcgacttgttgctgtgtaaacccttgagaaactcttgctcgtttaagttgttcggcaaaactcatatcgcgtacctcgcttccaaggatatcataatacaaacttggcgatatgtcaatattttttaaaaaatggcttgacaaattggcgatacgagaatatactaaaattaagatttggcgatacgccaagtaagggggatgaaaatatgtatccaaatctattagggcaaaaggcataccaccatcttaccgacgaggaaatggggcgagtaattggcgttagccgcaatacctacagccagaaaatcagaagcggtcgcttctggcctggcgaatgtcaggcatattgcaggtacttcaagaaatcgtttgattacctgtttgcaactgacgaggattcagttggcgatacgcccgtagaccgcacagcgtaggagggaaacggatatgaccgatctagtgttcctagaacctaacaagctaggttctgagccgttcacaacctcaaaggtgattgcagagtttgcaggaatcggacataaaaaattgaagtccgcaattgttaaacacaaagaagggttgcaggcctttggaatactggccccatataggaccgatattccaaggcgggggcgtgggcagccggaggttatttataagcttaacgagcaacaagcttattttttaatgacactcctcaaaaatacgccgatagttgtagagtttaaacgtaagctggtacaatgcttttttattatgagacaggagcttacacgccgccagattttccgtgacgcgggcaagcccatccgcaggacattgacagacgctatccgggatagtggggaagatggccgtatgcacggacacgcctacggcacctacacagacttggcctataaagccgcgacggggaagatcgcccgggtacttcggaaagaacggggggcctctgcaaaagcaatcgcaacggactttctcacgtcggacgagctgtccgcttacaacaaggccgaggaacgcttgactgtcctgttggacatggggcttacatacgatcagatcaaaacgctgcttttagtccagaggggcaaaaggatggccggataaagcaaaagccgtccagcggcggtgtggatggctaaagcggataggagcagaaaggaggcgtgacgatggctcagattataacaacagccgccagtgctgtggcggctgtatgcaacatcattctgatgattttgctatataggtggtatggcgtcaagaaagacaagcgataatgcttgccgtagcagctactattgaggccacggcagcgacagtaccgatgacagttttgcagggaggtgacagaggtgacgaatcaagaaatcaaagaaacgctcgaaaagcagttgcagctactctccgagcgttcgataacttgctcgtcagaagaatccctggcacacgtttccgaaacgatgattagactttcggaaaaattgcttgagatggagaagctgcaaattgatgatggcggcacaactgaaagcccacttgacactatgcttcaagctgttcagcaagccattgatggtattgggtcaaaatagcctctataatcgcgaaatttgttttgacaatcagcttatattgctcctgagtgaacggattatagttctctttcatgttgggcgcgctgaatgaggttaaatcatagctcagcttgtcaggatctatactgctcaaaaattcgctgaatggtggaagaagcataatttcacctcccttctgcggtcattttaccacatgaaaacaggggagacaaccaaataaagatgccccgccgggtgtcggaggcacccagcgaggcggcaaacctaattgaccgaaccaatcaggcttgcaggaagattatagcacatcctccttcaagccgcaacaagaaggaggacaaaatgtctgatttgacagtgagagagctaaagcgggatgcgtcccgcgtcaagcgtgagatagacacgctcgaaaaggccgcgtatggcatgacctttgaggaactgctccggctgctggccggggggcaaccggaaagcatggagagggaaacagagggattctccgataatcacctggcataaaaaaagccgcccgaaggcggcaaaaaggcgttcaaacggcctcatgatactctttttcgtgccggcgaatggacatctgtgtgtcctttgcggcctcgttgatgcaggtttcgaggaaatccagacgttcgtccactttatcaaaacgggcattcatcttatcctcgagcctattcaaacgatcattagttttctgttgctcaatttgcatctgttgcaggattgctaaaatcttttcttcgttgttcatggcgcagcctccttcgggatggtatttctactatatcacgttgaaacaaggtggtcaaccgttcgcagggacactaacgcacagcaccccaaagagaaagaaaaaggatgaagtgattatgaggtttgcggataaattaagaaaccttatgggcgatctaaatttgacgcaatctaaactttcaagccttaccggaatcggtaaaccctctatcagccagtatctttcgggccagcatgaaccatccaaagcccgcaaacaggagattgcccgggcattgggggtacaggaaaactactttgaaacgtttatgcccgctgcaacggttcagaacgacgaagtagggaatttgtcaattgttcttgtggcaaagttgatgaagaaatccaaagaatttgtggaagatggcttaaagcaaggcacttgcccgtttggatatgcggttaagatgaaaaagtggagttactatatttctcccaaaaggtttaccgaatatacgggaattgaagtccccctgaataagattgccggagatcagtgaagcgcataaaaacgcccctgtgagtgtgtcaaagatcaaaatatgaggagtgcaaaaatggaaaaaggaaaattaaatgaaatcttaatcagcggtattgcttacattccgaaagatagcgttacgagtatggctcctgttctggatggaatggagtattgcatggtgcggacatattccgcaggcgtattcgctggatacgtcgagagcaggaacgggaaagaagctgtattgagaaacgcacggaggatttggtactgggcaggcgcggcaagcctatcgcagcttgccgtagacgggacgagcaaaccagatgcgtgtaaattcccttgccccgtcgataaagtcgttttaaccgaagtgattgaaatcatcccgattacgacgaaagcgaaaaacagtattgatgaggtgccgatatgggaagaatgaatgcctgctccggcgacggctacagttccggcgacggctatagctctggtgacggctccggcgacggttacggctccggcggcagctatagctctggcgacggctccggcgacggttacggctccggctacggctccggcggcagctatagctctggcgacggctccggcgacggttacggctccggctacggctccggcggcagctatagctctggcgacggctccgacgacggctacggctccggatccggcgacggcgacggttccggcgacggtcacggctacggcgacggatctggctgctgttaaaaaaatcgcccttgcccgttggcagacaggtgggggcagcgaaaggagctaataaaaatcttggatttaacaaacaaggaataccgtttgctgaaaaggataagtaaacgcccgcttagaagtggcagaattaacccaaaagatatggccgcgttatcgcgtctgattgaactgggctatgttgaaaggtcattttcgcagcagggaaataaccagctcaacgataccggagaaatgctcaacaagaagaccgaggacgaaagttatcgccggtacaagcacattcagtacagaaatcttgttctcaaatcgctgctgacgttttttctcggcctcttgttcagctatatcctcaagttcctttagttatgaagcgaggtgagaacattgaaaattgaatgttttggaacctttcttacttcgggggagcacgccgaaattgttcgcaacaagctgattcccgatattctgaaactaattgaggaaagcggtatcagttgccatgaggcaacaactgttccagacgaacttagtgcagctatcgaatcaaacttattgaggaccttgcactctacagcattcaaagttcagccttttatggaataacactgcccaagcttattgcggccatatccctaaggatggaaaggccatccagaaaggagaaaaatgataacagtacattggcttaaagtttttgcggtggcagttgcggcatttacatttggcttggccatatgtaacacaatatgggtattctcgttatctcagcataagcgcaagaatagcgacaaaaaggctcccaagaccaaccgcagtagagatgatagataacactttagagacgcaagcatctaccctagcggattctgcctgttttttggcaaactcagcattttctgcggcaatgtcagctatgcgccgcagttcttggacttctccggggtcgggaagaacaatatcgttaccagaagtttcagcgatttttactccgctgcttgtgtaaattgccatgatgcctcacctcctttccgcaatgtcactgcggccgcagaggtaatctaaggacacgtcaaagaagtccgcgagggcgatgaggacgctggcggttggctcatttctcccatactcataaaactgatacatagatacagacactcccgcggcttgcgcggcttgcgtctgtgttgcctttgcacctttccgtgatcgttttaatgcctcacgcaactccatagtgttataccccctaaaaaattacaaagaggtattgacctaatatatttggtgtgttaaaatgacaataacacctaatatattaggcaatccagaaagagaggagaaagtgaatatggaactaagggcggcccgtaagcagtctggcaagacacaagcacaggtcgccaaagaagcggaaatcagtgaagctcaataccaaaacatcgaatatgggaaaagtgagccaaacgtccgaacggcaattcggattgcagatgttcttggtattaggtcgtatgagggcttcaccaaactctttgggtaaagcataacacgacacgaacaaaaaggcaaggaggacagcatgacgattacaccggaggtcaagacggaactgctggaaatgctgcggcaggaattggcgcgggaggaacagcggaaaaaggaaaaccggacggcataccagagagcctgcaaggactttcaagaagcctttgccggatttggctatgaggaaattcacactggttcccgaacggatggaagcgtatgggggttcaacgccggacataagatgcagcataaggtaagggatgccatcgggacgctgctgcgggcggtttaccaagtggacactgttgcaaaactcccggcggaaaaggaaccgcaaatgaagcattttatcagttcggttttaaagttgatgaacgagcaaaaagacgccccccgctttcaggaggcggagataaaggaggacaaaaaatgaacgaattaatcaaagtggatttcacgggtgaccgccccgccgtgtcggctcgggaactgcacgagtttctggaggtgaaaaccgcatacaaagactggttccccaggatgtgtgaatacgggtttacaactggaacagatttcaacctgctcaaaattgagcgggttcagatggagggcaatcgcatggtttcccggccggttgaggatgcagccctcactattgacatggcgaaagaaatctgcatgattcagcgcaatgagaagggcaagcaagcgcggcaatattttctccagcttgaagaggattggaacagcccggaaaaggtcatggctcgggcgctgcgaattgcggagcgaaaaatcaatgggctggaggaaaaggtcaaacaggacgccccgcttgttctgttcgcaaattccgtcagcgcgtccaaaaattccatccttgtaggcgagctggcaaaactcctgaaacagaatggggtggacaccgggcagatcaggctgtttaagaagctgagggagcgcggatatctcatccgccggaaagggtcggactacaatatgccgacgcaaagggctatggaactgggcctgtttgagatcaaagagaccgcaatcacccattcggacggacatgtcagcgtaaacaagaccccgaaagtaaccggtaaggggcaggtatattttgtaaacctgtttttggcagagaaaaaccccgcccccggcaagcaagaccagggacaggatttctctgttacagtcagttgatttaaaggttcgcctccgggaagtgttagcggcactccccgagggctggcaaaccagattgaggcaaccaatcaggtctgttgaggaaattttaccatatcctccggcctgatgcaaggataaggaggatttttatgtcaaacggcggatacttgggcgaaagcagcaccaaagcggaaatcgagcggcgttttctcaatgcaaagcatgtcatggatgcttttatggaggcatactacggcataaccttcgcggagatggtcaggctgatggggccgaaggatgacggagaggggaaacacaaacagtagtaaggagcatgacaacatgaggcgaatcaaagtgatctacggagacggaacaaccgagcggtattgtgtaaacgtaagctatgcggaggctttggagttggcgcgcaggcaggcgcggaaacagggtacatacgtgcggggattcagttgtgtatggatatgacaaaaaagccccgcaggactggcatcccgcgaggcgcataagaaaaatgtttcatctaaattttacgcaatgctgcgtaaaaagtcaagagggatattatgaattgcattgaacgatatgaagcggaaggtacggcgtcaaaaatatcggctttccgaattaagcagcagctaccatatgaacaaaaggtaattcttgcggaacgccgggcaaaagaatattatcgggaaattactggacgcgggcagaacgtccatgtttcggtgggcggtctggacagcattactttgcttatctttttgagatcaattggtttgaaggatataccggctgtctcggtatcatgtctggaggataaaagcatccaaaagatacataaaagcctgggcgtcataccgttaaagccattaaaaagcaaagtggaagtaatccgtgaatttggattccctgttttatcaaaggagatcgcgggaaagatcgatttgctccagcgtcccagtgacagaaacgccacagtccggcatgccattatcacaggtgaaacaggagactatggcgggaaccgcacaggcacacgtatgaagatgcctcaaaagtggcttgaattgtttggaggatatgaaaacgagaacgagggcgtcaattatcagatcgcgccttttaaagtatcggacaagtgttgttattacttgaaggaaaagccttgtgacgattatgcgcgcaagcataacagcgtgccctatttaggactgatggcctcggaaggtggacggcggcaaaaatcattgatgatgcatggatgcaattattatggcaaaacagttacacgcagttgtccatttgcaatttttggccgtcaggatttattgcagattgcgcttgatctaaatgctccagtgccagaaatctacggcggaattgtgagagatgaggatgggacgctgcgcacgacaaaggcgcagcgaaccggatgcagcatgtgcgggtttggaatccatcttgaaaagcggccgcatcgttttgaccggcttcgtgaagaaaacccggctgaatgggatttttggatgtatcgctgcgctgtcgattcggagactggagaaccgtttggttgggggcgcgtacttgactatattggagtgccgtatagagcagagaacttaaggtaaaggattgtgtcaaatgaaaaaatacgagcttacaggggaaaccatcaacgtatttggcaagacactgcaccgcattagggccacaagggacttttctaatgtacatgctggtgatttaggaggatttatagaggatgaacgcaatttaagtcatgatgagaatgcgtgggtcggtggcaatgcgcgggtcagcggcaatgcgtgggtcggcggcaatgcattggtcggcggcaatgcgtgggtcggcggcgatgcgtgggtcggcggcaatgcgtgggtcggcggcaatgcgtgggtcggcggcaatgcattggtcagcggcaatgcgtgggtcggcggcaatgcgtgggtcggcggcaatgcattggtcggcggcaatgcgtgggtcggcggcaatgcgtgggtcggcggcaatgcattggtcggcggcaatgcgtgggtcggcggcaatgcgtgggtcggcggcaatgcattggtcagcggcaatgcgtgggtcggcggcaatgcgtgggtcggcggcaatgcgctagtcaaaggcccgcgggacatatattggatatcctgtattggttcgcgtaacggcacgacaacatttttccgcaacgcagacaacggcatcagtgtagcatgcggatgcttttatggtacaatcgacgaatttgcagccgcggttacaaagacgcatggagacaatgagcacgcgcgggcataccgtcatgcgattgagattgcaaagctgagaatcgaattggaggttgccaaatcatgaggcgcgcaagatatgtgggttgaaaaaaggagcgagaaatcaaatgaatatcaaagatatccttgacaagcacgcagcatggctccggggtgaaccggagggcgtaaaggctgacctgtccggggctgacctgtccggggctgacctgtccggggctgacctgtccggagccaatctgtccggggccaacctgtccaaggtgttaaatatcgatactctgtcgtgggattcgaatactgcattttatcctctgcaatgcccggagactggcacatacacagcttacaaaaaggccaataatttaatcgtggagctggaaattccatatgacgcccttcgctcgtcggctacaagtcgcaaatgcagggccagcaaggcgagggtgatcagcattacagatctggcaggacaccccgctggggatcgggtgttgagcgactacgcctacagcccgaaaattgaatacattgtcggacaaacaattgagatccccaattttgatacaaaccgctggcgtgaatgcgcccctggaattcaccactatatcacaagggaagaagccgtcaagcatgaaaattaggcagccaaccaggggcagacgaacgcgcacggcatttgcggcaaataccccgaaaatagcggaggaacaacattaaaatgaacgcatccttattaagcagcaaaaaaatggactattgcacgccacaagacttttttgacaaacttaaccaggaatttcatttcacccttgatgcggcagcgacctcaaaaagcgcgaaatgtccgcaatattacaccccggaaatcgatgggataaaaaacccgtggagcatagcaggcggcggtgctgtattctgtaatcccccatacggacggaaaatcggaaagtgggtgcgcaaagcctacgaagaatctcggaacgggacaacggttgtcctgctgattccggcccgaacagacacggcctattttcacgactacatatatggatgcgcggaaattcgctttgtgcgcgggcggctgcatttcacggatgaggacggcaacacatacgatcgcgccccattcccctctatggtagtcatctacaacgggaatagagtgggatgatgaggaatgattaaccaagacctacagcgagccgttgggcagacagcacagatggagccagaagaaatcatcgaactggaaactgggatggaggaataggagaaatggattgcattttttgtggagagtagttcgtaagtggtggagattccactatctgtcctccttgcgagagggcgatgaaacggttaggaatcaaaatgtcccctgaccgcctccgtcaacttgtgcaggcggagaaggatgggaggatcgtgttgctgccgtgtaagcaaggagacactttgtggacattctgcacctatccgttcgcaaaagtttacaagtttaatgttacagacatttcgatgcttaacggaagaacgatgctcaacacagatcttatgggggttgtagatgcaacggatgtggggaaaaccgtctttctcacccgcgaggaagcggagaaagcattggaagaaaaccgctgcggagaatgaaactacatacagggaggaattacaatggatatcaacgtaactatcaactgccccgatctgcttatggcagctaccacactggcaaaagcattcacttgccgctgccatgcgcacaatgagagcgagacccctcaggcggaggctttcaacgcgcccgctgccaacgccaccccaaattccacggccgtaccaaccacagcagccccgcagatcacaggagccctgattgcaaaggccggcgccgacttgatcggccgggattccagcgcgcttggaccgctgaacgccctactgcaaaagtacggggttacgtgcgcgcaggatctgaaacctaaccaactggacgctttcgccaccgatatgcgctctctaggggcaaagatatgaaattttgcaggaggtacaaaatgaaagaaatacttttccgcgcacagcgcatggacaacaatggaagaggtgagacagggtatgccccctgagaaacacgccctgctgggtgcaagctcggcccaccggtggctgcattgccccggctccgcaaggctaaccgaaaatatgccggacaatacaagcacctatgccgaagccgggcggctggcccacgaaatcgctgaactgaaagcccgacagtatttcatcgaaaatcagcccaagcgtgcctttaacgcgcagctgaagaagctaaaggaatccgaacactacgacaaatccatggaattcgccacagacgaatatttggaacacctgaaggccttagccatgtcctacccggtgcccccttcggtggctctggaggcgcgagtggacttctccgacatcgtgccggacggctttgggacggcggactgccttatgatcggttctggccgcatcgacgttgtggactacaagaacggctccggtgtcgtggtagaggcggagaacaacccgcaaatgatgctttacgcttggggcgctctaagatattttcgccccattttcggggatagcatcaaagtaatacatatgtctatcgtacagccgaatgccggcggcgtccgagaatgggaggcacctctttctgagcttatcaaatggacggaaaaagtagtacgccccaccgcaaaacgtgcatttgacggcgtggaggactatcaggcgggggaatggtgcaagttctgtaaggccaaagccacttgcagtaagcgcgcggagggaatgttcaccgtagaaccgataatgcactctgcccgtacgggaagcgacggcgcaaagagcatccagacgacgggtgcgctgaccctcaatgatgaccaggttggcgaaattctgacacgtgccagagaagtggcgtcatggcttaaagatttggaggactatgccctgaaagccacgctggagggccggcatatcgcgggatggaaagctgtggagggccgcagcagccgggaatggagcgggggcagcgataaagcgtttactcaactgcaaatccggggcgtggcggaaacgatattgtacgaacgaaagccagtatctgtggcagggttggaaaaaaccctcggaaaaaaagcattcgcggaaattgctgaagggctgtggaccaagacccctggtaagcccacccttgcgccggagggtgacaaacggcgggcgtacagcccggcggcgtgtgcattcggggtggtgaacgaaagaaaccctgcatagaacaaaaggccgcgagacgcaatttcccaagtcggcccaagcgagaaaataagcgaaaaaggagctatttatgcctgagatcataaccaccaaggacggtaagaaccatacgttagtaggcagtacatcactgatatccatcattcgcgactattgcggggacgaaacagccaaagcttgttgccggagggcggctgcagtcatggatgaacttgaatatattttggatatcaatggcattagcgctgcgaaagccgaagaaattcgatccgctgtccaaaatagcataaatatttattaaaaaggagaaatgtaattatggctatcacgatcaacaacgtccgtttgtcctactgcaacctgtttcaggcaaaacccccttataacaatccgaacggggaccccaaattcagttgtaccattcttgtacccaagacgaacaccgaggccaagaccgctattgacgccgccatccaacaggcgatcgagcagggcgtgtccaagtcctggggcggcgtgcggccgcctcagcccaacatctgcgtccatgacggcgacggcgtaaggccaagcgatggcgcccccttcggcgcagagtgcaagggcatgtgggtgttcaccgcctccgcaaaggcggaccgccctcctttcgtggtggatggacaggtgcagaagatcatcgaccccgcccaggtgtactccggcatgtgggccaacgtcaacattaacttctttgcctacaattccgccggcaagaagggcgtcggatgcggcctgaacggcgtgcagaaactccgtgatgacgagccgttggtcgagcatgtaacagcggagcgcgcattcagcgtcatccctggcggcaatacatcctcgcagcataccggatggacccctaacgccgacctcccctggtaacaggttatgccagccaatacgattcatcatcttagctgcgatatagaaacatacagcgatatagatattggaaaggcagggctgtacaaatatgcggaaagccctgccttttccgttctattgttcgcctatagccttgatggcgcgcccgtacaggtagtagatttaaccgcggacgaaaagatacccgcagatataacagaacatctgttcgaacagaacacaatcaagcatgcatacaacgcctcatttgaaatcacatgcctgagtcggtactttgacaggcaacttccgccgtctcaatggcgctgcaccatgatccatggaatgtatcttggctaccccgccgggctggacgcctgtggaaaggccctggggctgccgcaggacaagcagaaaatgtcggtgggtaaagctcttatccgttatttctgcgtcccctgcaagcccacaaaggccaacggagaccgtgttcgcaacctcccccaccatgaccccgcaaagtgggagctgttcaaggaatataatgcacaggacgtagtaaccgaaatggaaatcgaacagcacctatccggctacgatgtgcctgatgagatacagggacagtgggagatagatttttccatcaacaccagggggattgcggtggacatgacactcgttgaagctgcacgagagctggatgcaaagacgcggcagaactatatcgcagaggcgcatgctctcaccgaactcaagaatccaaacagcgtagcacaattgactcgttggcttacagaacagaccggagatgaattgcccaatctggcaaagggcaccgtgtcacagatactcaagagtgatctgccggaaggccccgcgagacggatgctggagatccggcaggagctgggaaagacctcgaacaagaagtacgacagtcttgccgctgcaacctgtacagacggcaggatgcgggggaccctgcaattttacggggcaaaccgaagcggccggtgggcaggcagacttgtgcaagtgcagaacttacccaggacatacatctccgggaacatacttcctttggcgagagaactggttaaagcgcagaacgctgatgggttgaattggatcttcggcagcgtgccgcacgccctctcccagctcatccgcaccgcttttattgcatcgcccggaaacatgctgctggacgcggatttctccgctatagaagcgcgggtcattgcgtggctggcggatgaagattgggtgttggaagtgttccggacgcatggaaaaatctacgaagctgccgcgtcgcagatgttcggcgtccctattgagaaaatcaaaaagggacagcctgaatacgcctaccggcagaagggcaaggtcgccacgctggcactgggctatcagggaggcgtgaaagccatgcgcgcaatggacagcgggcatgagctggacagcctgtcggatgaggaggtacaggagcttgtgaacctgtggcgcggcgccaacccgaacattgtaaagctatgggggataatggaggctgcggcgaaagcggctgtcacggagggccgaacctcttttctgccgcatggggtagttgtgagcaggagcattgacacaaacagcggtctggacttcctgatactccaactcccaagcgggcgttcgctctattatcctaaacccgcaatcacacaaaaccgtttcggcaggccctctgtctcctatatgggccagaatcagaccacaaagaagtgggaacggatcgagacatatggcgggaaattggcggagaatctgacgcaggcagtggcccgcgactgtcttgccgacgcgatcaccaggctcgaagaagcgggtttcccggtggtgttccacatccatgacgagattgtggtggacgtttcaccggagaaacaggatctggctgaaatgaaacgactgatgtcggccgttccgaaatgggccgaggggcttcccctcaaggcggaaggatggtccaatgaatttttcaaaaaggattgatttccaggattaaaaaggagcggcgaccataaaaggcggagatggtcaaggcgtatatttgcatccgcaactaaaatgaattttgtgtatacctgctggaaacacccagccccaaaatgggccgccgcggcccctatttatagcaatcagggaagggagatatcatgaaagcttacactcggccaacgctgacgcatagagaacgccaaattgcagccgcggagatggacaaaataaccagaaagggcatctgccgtgcgcaatggctgatgctgatagcctttaacgaagcactgggcataggcgctcaaaggatccaacgtgtaatgaccagctatgcagggctgctgacagaattcgaagcgtacgcaagagacggtattgaggatgaaatgcttacgcgtcgattgaagcagatcggtttggatgtaaagaagctgtgggagggctgacacaaatgtggaagcctattacggggtatttaaacaattaccggataaatgaacttggcgttgtacagcagcttcaacgaggcaagtggatatctctgatggttgacacaggggggcctcgggcggaggtcagactgcgcggattagacggaaaacaaaagcgtgtaggcatttttcggctactggaccgatgcttttgcggaggatacgccgacaaaaacggcctgtgtgcaattcctaaaaatggcgtaaaatctgaatgcaccctcgaaaatttaagttacaaggcacttacagatataacaagcgcggcatgttcccgagcgatgagcaaagctattgtgcgatacgatcgaaacgggaacatggagctgtacaggagcgttactgaagccgctaagaaaagcgggctgacgctgtcatcgctggaacgacggctgcgtcaggaagtcttagacccaagaggatacaaatgggagttgttggaatgataaatgaccggcaaattacaatcactgtaggagccagccggaactctgtcgactggctcccgcaaataatgtggctctccgaattatgggaacggttacggacgccgcagcgcggtacagaaactgtagcggaatacttggagttgcccaagggggagcaggacaaacggaaagatgttggtgggtttgtagcaggaaccctcaacggcgttcgccgtaaggcgtcggctgtgaccggcagggacattataaccctagatctggataacatcccaaatggacaagcggaccgtgtaagtgcgagcataggcgctttgggctgcggctactgtatctactccacgcgaaagcaccggccggacgcgccccggttgcgggtgctctttccactcgatcggacctgcacggcggatgaatacgaaccgctggcccggaagatggcggagcagattggcatggagttggcagacccgacgactttcgaagcggcgcggcttatgtactggcccagctgctgccgggatggcgagtacatttattatacagacgacaagccgctgctatcggtggatggtctgttagctacatacaccgactggcgcgatgtgacctcctggccgaagcatcccggtgcgacgccaaaagcccggctggcggcgaaacagggagacccggaggaaaaaaagggcattgtaggggcgttctgccgcgtctatgacgtacctgcggcaattgataagttcctgcccggcgtctacgcggaaacgactgcagcgggccgctacactttctgtcagggcaccaccgcaggcggcgcagtgatatacgacaatggcaaattcctgtattcccaccacgcaactgacccgtgcagcggtaagctggtgaatgcattcgactgcgtgcggctccacaaatttgaggagctggacgacgcggcggaaccgggaacgccggtcaatcggcttccgagctataaagctatgatggagctggcagtgacggatgcggcggttgccggcttgttgagcgacgaacgatgggagaaagtgcaggaggcatttggcgctatactggaacaggatggcgaggatgacgatggttcctggcggcgtccgccgatgatggatgtggacgcccagggtatgcctgtcaagtccatgaagaacctgcgcacggctctgagcaacgatccgaaactgaggggccagctgcgtctgaaccagttctcaggccgaattgatgtgacgggaaacctgccctggagccgcgctgaaacaggaaagacctggaacgatacggacgccgcgcagctacgtatctatctggaacccttcttcggtaagatggcgaagaatgatgtgctggacgcagtagacgcctgcgccagcgatcaggcataccaccctgtccgcgactacctgaacagcctcacgtgggacggcgtgccccgactggacacgatgctcatagactacatgggcgctgaggacacgccctacacccgcgccgtgacgcgcaaatcgtttaccgcagccgtggcccgtgtcatgacccccggcgtcaagtatgacactatgctggtgctggtgggcgggcaggggcggtataagtccacgctcctggcaaagatgggaggggattggttcagcgacagcctgcgcaccttcggtgataaagacgcaatggagaccgttcagggaacctggatcaacgaggtggccgaaatgcaggcactcgcgaaagcggagatcaacgccgtcaagatgttcctatccaaacagagcgactattatcgagccgcttacggccggtatgcctcggacaggccgaggcagtgcgtgttctttggaacctctaatacccgggattgcctgattgataccactggaaaccgccgtttctggcccgtggatattgaccggcgggagcggacgaaaaacccaggcgaggacttgacgcgggaacgcgaccaactatgggccgaagctatgcagtactggaagcagggtgagaagctgtatctgtccccggagatagagaaggccgcgcgcggtgtgcaggaagaccaccgggaacagcacccatgggagggcatcattgccgactttctggaggaagaagtgccgatgggatggaatggttgggacttgcagaaacgacaggtctggcgcagcggcggcatgaagtgcgacgatgctacggctccaagacagcgggtgtgcgccattgagatatggtgcgaagccctggggatgcacagaggcgctatgcgccagcgagatgccagagagatcaacaacctgcttgcgcggatgcccgggtgggagtacataggcagtgttcagggaggtaggccctatggaaaacagcggtgttttgataaaaaatgagatgcataaaaataacatattataaaatatttatgcatttatctcggaacacttttgattttaggtggaacggattgcagacaatagtaaatttttggaaggaacagacggaacaaatggaacaaatgaaaaattgcaatctgttccacctaaaacgccgattgtatggggatttaacaataatggaacagatggaacagacttacatatagagtacttttaaatagagagattagagaatatatgtctagtaatatattctctaatccgcctaatacgtagaagtatataggaaagcccttaaatctgtggatttgttccactatgaatttgtatgaatattcgcgggaggatttgcatgagggaatcacagatcgaggcgcggttaagccgcggggtgaaacaggcggggggcttatgcctcaagtgggtatctccggggtgcaccggggtgatggacagaattgtattactgccgggcgggcgggtcatatttgttgagctgaagcagccgggtgggagattgagcgaaagacagaagtggatggctgacgcattggcccggctgggaatggacgtcaggtgcttgtggaacaaagagcaagtagacaagtttttggaggaggtgacgcggggtggaattccatccgcataagtatcagcagtacgctgtgaaccggcttatccaggatgacagtattggtttgttcttggaatgcggccttggcaagacggtcatcacgctgacggcgatccgggaactgcggctgcaatggaaggtcgggagagtgctggtggtggcgccgaagaaagtggcggaagccacgtggaacaacgaggcggcacagtgggaccacttgaatgatatgagggttctaccagtgctgggtacgtcgaagaaacggatacagacgctgaataccccggcggacctgtgggtcatcaaccgggaaaatgtaccgtggctggtggattattatcgcaacagctggccctttgacatggtggtgttggacgagagcagcagctttaagaatccgcggagcatgcggtttaaggccctgcgaagggtacggacgcggatacgccggttggtggagctgacgggaacgccgtcacccaatggattggaggacctgtgggcgcaggtttaccttctggacggcggcgcaaggctcggacggacgctgacgagctttcgggaggcgtttttcactcaggactatgcctatcctggacagccctaccggacctacacgccgatgcccggagcggacgagcgcgtcgagaaagctgtggcagatatctgcgtcagcatgaaggcggaggactatctggaactgccggactacattgaggacgttgtgcccgtggaacttgacacacccgcgagaaaagcgtataaaaagctggagagagaaatgcttctccaggtggctgatcaggtgatcacggctggaaccgccgcagggctgaatggaaagctgctgcagctatgcagcggggccgtgtatgacggggacggtacgccggtggagattcacaactgtaagatcgaggcattcctggagttggtggagcagctgcatggaaaacatgcactggtgttctactggttccagcatgagcgagaccgcttgatggaagcactgaaagcggggtttccgaatctgcgtgtacgactatacggaggaaatgcggatgcatcggcatggaatgccggaggtgtggatctgcttcttgttcatcctgcgtcctgtgggtacggccttaacttgcagtatggcgggcatcacatgatttggtacagtttcccgaactggtcgcttgagctctatcagcaggcgtgtaagcggttgccccggcaaggtcagaaacatccagtggtgtctcatttgatggtggtgcagggcggtatggacgaggcggtgttaaccgcactgcgaagcaagggcgacgcgcaggcggctttaatgcaggcgctaaaagcgaaaatagattcggtgagaaatgagaagtaggtataaaaattagatcctcgacagtacggggcaattaagagttgattctggtttttataacggaacaggatgggtgttaagcatggccgcacggctgacggataagcagaaaaagaaaatagtggccgattatctagagtgccagtcggtcaatcttgccgccaggaaaaacggcgtttcgtgggatagcgcaaagaaagcccttgaagaagcaggagagatcgagaaaaagctggagcagaaaaaagaggaaaacactgctgacattctggcgtatatggaaagccggaggcaagcggtatgcgatattattgaggtcggccttgaagtgctgcccgataaaatccgattatcgaaccgcgcctcagatgttacaaccgcgatgggaacgctgatcgacaaatggaccgggttcagctccggcctgggtgacacagctaaagaggatgctctgagccagagcctgagagaaatggcgaatgggttggcgagcgatgattagcccaaaacagaaaaaaatactcgctttcccatactccaaatacgacgctattatctgcgatggagcggttagaagcggtaaaacatctataatgacagttgcgtttattgattgggcgatgcgagagttttctggacaacgctttggcttgtgcggaaaaacggtagattcatgttcaaagaatctggtcgtcccatatctttcaatggcttattctaagcagaaatatattctgcgctggcggcggtcggataagattcttgaagtacgccgcggagccgtgacaaattatttcgaggtattcggcggcaaggatgaaagctcctttgcgctgattcagggccgaacgctggcgggggtgctgctggacgaggtggcgcttatgccccgctcctttgtggagcaggcattgacccggtgcagcgtggacggcgctaaactgtggttttcctgcaatccggaaagcccgcagcactggttttatctggagtggataaagaggcacaaggaacggaacgtcctataccttcactttgagatgacggataatcctggtctcagtcaaaagacgctggaacggtatcaatccatgtttgccggggtattttatgaccgttatattcggggtttgtgggttgtagccgaggggctgatctatcccatgttttccatggaacgaaacgtagcgcgcggtgaatcaggaggccatgggatgtattatatttctatcgactacggcacaaagaaccctacggcgatggggctttggcgcgtctacaagggcgaggccgttatggagaaagaatattactatgacggacgggccaggcgcaggcagaaaaccgacgaggaatattatcaggatttggagcagttttccaaggagtacaatattgagcgcgtgattgtagacccgtcagcggccagtttcaaggagtgtattttcaggcacggcaaatttccagtttgggacgcagataattctgttattgacggtatccggcttacgggatcgctgttgcagacagggcgccttaaattccacgaaagctgcacaaacgcgtttcgggagttcgggctttatatgtgggacgacaaggcctcggaggacaaaccgctgaaagagaacgaccatgtgatggatatgatacgctattttgctgcgacagttatgcggagggaatgatgctgtgaatattctggcggatatttggggaaaagtaaaaaacttcatcttcccgcaggctgctgcggggcgggtattttctgtcaagcctgttgtgagccagtccatggagcggaatatcaacctctggtatgccatgtatgtaaatcagccgccatggatggatagccgggtgaagccgctgggaaccccctctgctatctgccgggagttagcccgacctgccctgtccgaacttgtggtgaacatcaccgggagcgcgagggcgaactacttaaacgagaatttccaggcggtgagggaaaatttcctgcaaagccttgaaatgggccttgcagtgggcggtatagcgtttaagccgtatccgtatggggataagattcttgtggacgccaccagcgcatccgcgttcaggccgactaaatacgcagcggatggtcagtgtatcggaggcgtgttccgcgagcggttgatgtccgacggaaaatggtatgcaaggctggagtaccacgatctggaagggacagattacaccatccagaacaaggcgttcttgagcgatagcagcggaagcgttggcgcgggcatcagcctgcaagatgtgaaagaatgggcgaatattcaaccggaaatccatattgccaacctgacaggacctctttttgcatattttaagcccccgcaaaggaacaatgtggagattgacagcaatgcaggtatgagcatttatgggggggctgtggttgacctcattaagcaggcggacgaacagtgggagctgattcaatgggaataccggagcggccagcgcaaggtgctgatggacggcacatccacaagggcaaaagattttgataaccgcctgtttgagattggaccatttaccagcggcgggtctttttatcagcagtttgaacctgttttccgcgacgatgcgttgtatcggggcctgcaaaacatacttaaacagattgaattccaggtcgggatgtcctatggtactctgtccgaccctcagagcgtggagaaaacggctacagaaatccgtaacagcaagcagaggatgtatatcaccattgacagcatccagaaagcattgcagcacacctttgacggccttctgtacgctatggacgtgtacgctggtctgtataatcttgcgcccgcaggaggctatgaggcgtcctatgactggggggacagcatccttgaggacgcagacgcgaaggagcgggagcgggctaacgaccgccaagacctggctgcgggtatcctcaatgattgggaataccgtgcaaaatggtacaatgaaacggaggatgaggccaaagcagccctcccgaaagcgcaggacatggtggatgaggaacaggatgaaattgaatgaggccgtacccctttaccccatcttatttagacgctctccccgaagaactggcggaactgtttcgggggttggaaataactctgcttgaagaaatctgctcccgcctgaaaatatctggccagttgaacgaggtcacggttgcaggtatcaaagctctgcgctcccacggcatagacctcgaaagcatcgaaaaggcaatttcagagacaacaggcgtcgggcggaggaagttggacaaactgctggatgatgtggtggagcgaaatcaggcgtactatacagagctgatagacataaccaaagtaaccgctccggaaaccctcttgtcagccgctacggcggacgctatcaggcggcaagcacagagggagtataggaacatcacccggtctatgggattccttttggacagcgggaaaacgatgctggcaccggcgaaagcttatcaatgggtacttgacagcgccattttgcagattgagagtggggccattccttacaatcaggcgattgcctcggcggtcaagcaactggccgatagcggcatcaagaccgtggactatgagagcggccatgtagaccaggtggatgtggcgatccgtagagcaacgatgacgggcgtggcgaacataaatcaacagtattctatccagtctatggagtatttaaacacgaatttagtcgaagtgtcagcgcatatgggggcgagaaacaaggatggcccaaatggatgggaaaaccacgaacgatggcaggggaaaatttaccgttggaacaggagaaggtgatgtaatggcagtttatccagactttgaacagttgtgcgggtatggaagcgtgaccggtatcggtggagcgaattgccgtcattagcacaccttctcgccgtttattgagggtgttatgaagcgcacctactccgacaaagaccttgaagccatgaagggcgaaaaccaccgctttacctatgacggcaaggaatacgatggatacacggcatcccaggaacagcggcgcatagaacgcacaatccgcaaactgaagcgtgagcaggcggcatacaaggcggctggccttgaagatgatgccacggcggtaacggcccgtatacggcggctgaacgccaaatacaaggaatttagcaaggcggcgggactgccggaacagcgggaaaggatgagggtgctatattgactattgatgtgctggggacagaatacacaatccgctttgtgccggaggaagcagatgaagggctgaacgatagcgatgggtattgtgatgacacggcaaaagagatcgtggtcaagcagtacaagcgcggggagccattgggcaaaagaaatctggaaatgcaggagcggaaaaaccaccggcatgaaatcatccatgcttttctgtgtgaaagcggccttgcggaaaacagtacatgggcgcaggaggaagaaatggttgactggtttgcgaaacaggctccgaaactgattaaggcatggaaggaagctggtgctttatgactgacacaaaggcggttatggacgctatcaacgctatcctcaaacgcgggaacgatgcgcagatacagcgcaacaaagaccgccttgttgtgcttgaggtgaaaaaggaagttaaatactgcgaaaaaagcaaatactcttgccaggaacagacatttatggtatactgatagtgtcaaaacatgaatattgtacctgccgctaattggggcggcggatgagggcaattagagccgactgactacgatttttcgtagttagtcggctctttttattttttgtaaacccgctcaatcgcataacttgtaaggctttcttacaggtttcctaggctcttaagtcttattcatcttgtgaaatatctgcccggattaattttttgatgtaaccagccttgttagggacgctgtccaatctttggatgatgtcttgctcggtggtttcaaccaggcggatcgtcagcagttttgtatgggtcttatggtatcgatcttgtggagtttccttttttgtcgtaatagatatcccctttcaaaaagatagggccggtttcccggccctgtggatgtcattgctgagaacctgtgatataggcgtcaattattttctccagctcggcggcggtgtaagtcttatccggatcttgtttaaggattctgagcaagtcatacgccatagccttttggacatccttgcgttcgttttcagtaggcatttgttgcccccctttctgataatattatatcataggtatatacctatgtcaatagcttttcgaatgatttttcgcataaaatccacaagatagtggttttttgataatttttgaccggcccgaagtcgagaaactacggggccgcaggggacgcgacccccgataacaaagcgaagcggagaaaggattagccatgaagcgtgaatttctggaagcattaaacctcgacaaagacacggtggacaagattttggatgaaaacagccgggatattgggcgggaaaagcagaaagcggaacagattaaaggtgatcttgataaagtccaggagcagcttgaacaacgtgacaaggacatggaggatttgaagaagtcagccgctgatgtggagggcatcaagaagcagttggaggaattgcagagcaagtacaacactgaaacggaacagtacaagacccagctcgcagaccgggattatttggacgcgatggcccgcatgattgccgacaagggcgttaagttctccagcaaggccgctgaaaaggcatttatggctgatctaaaggcaaaggccctgacgctgaaagatggcagtctggacggctttgatgacttcctgaaatcgcagaaagaaagcgacccggcggcgtttgaagcggagaaacccgctcctacatttgtcaagcctaccggggctggcgggcctcctgagcatgtgagtgcggcggcacaggcagccaaaaactttaccgcgcagtttatgaaaaaggagtgactatcaaaatggcatatatctccactaccaccggcaccaattcgaaaaactttttggagagcgccgtgggacttgtgactaaaacaatggagtttgacggtactgggaacaagggcattgtaaccactgaggggagccggaagatcgtcaaggcgggtacgccttaccccaagggggacgcaaccgcggccggtatcgtgtttgaggatgccgatgtaactgacggccccgtcgctggctctgttatggttgcaggccgtgtgctggagggccgtatccagtcgatcggtacggctaaagacacgctcaaagggcttgggattgtctttgtgactggccccgagactacccgataaggaggaaatgaagaatgcctgatattttgaagcttctgtccgaccctgaaaggctggacttttctcaaaatttctctgttgcccgccccgcctacctgggcgaccggcttttcccggacactaagacgcagaacctccaggcggagtatctgcgtcttgcctctggcgcggccctgcctgtaatggctaccgtccacgcctttgacactgaggcggagattgcgagccgccgcgcgttcgacaaggtgaacgtggagaagctgcttatcaagcgcaaaatcaaccagaccgagcgtatgcgtctgctgttggacaacggtttacaaagcaacgatgaagctgctatgaaacgctacatctttgacgatatggggcggctggctgaaagcgtcaagacgcgtaccgaggttgcaaagatggaggtacttgctaccggtaagatgaccatcaaggagaatcgtctgaacctcactgtcgattacggcgtacccaccagtcataccaacgacagctttacatggaatacgccagaaacggacgacatcctgggcgatatcttgaaggttgtggataaggccgcggatgagggtaaggcaattacccgtatgattacctcacgcaagatcattcgggctatcctgtccaacaaggctgtacagacagcaatttatggcactgccgggagcggtacactgcccaccatggacagagtgcagagcctgttccagcaaatgtttggattttctgccattgaaaccaacgacctgcgttatgcgatcgaaaaagcggatgggtcgcaagaaaaacagaggttttatccggacaacaagatttctttcatttctgagcagatcagcggcggccttggcactggcctgtggggcgtgcccccggaggaagccgaatacggccagtacgcgaacaagtctgctgaccagtacatcaccatcacccagtgggctacgcctgatccggtggcggtgtggactaaggcgagcggcctgtttattcccgtcctgcctgatgtcgacagtctgtatatcgctactgtaacggtgggggaatgacccccactggtgacgataatgcggttgttgccagtgggaaagtaggcaaagccaaagtaggccgcagaaaggagacataaggcatggcgtatactccgaccacatggaatacgggcgatttgattacagccgaaaaactgaacaagctggaacagggtgtacagaacgagcaggtaggccccgctggtccaaccggtcccaaaggcgagaaaggcgaccccggtgaacagggaccaaaaggcgaccagggtgcaaccggccccgctggtcccaaaggagataagggcgagactggagcacaaggccccgccggagtaggcttatcagggaacgcacagtcgattaccaagatttctgacacatcctctgcgcaggcttcggagattgcggagaaggttaacgctatcatcgaccagcttattgccagaggcgtgagcaaaaattaaggaggccgctcatgatatacgccgattatgagttttacaaaactgaatatttcggcgtggctatcagcgaagccgatttcccgcgcctggcccgccatgcaagcagttatattgactacatcacgatgggccgggcctccggctattctgcggacgacgccgtcaagatggcttgctgtgcgattgcggaggaatatcaactgccggaaatggcaaagggagcggctcgcaaggctctctacgctgccccagaaacggcggacgataccggggctactgtgggtatgggtacggtcggaaaggcagttgtgggccacacggcgtccacggtgagcgtatcggagccggaactgcaaagccagagcgtcggggcgtggtctaggtcatatcgctccgctggtgagagtgccgccgctgccctcaaagcggtggacgaaagcaatctcgcaaaggttgcggcaatctaccttgcccgggctggcctgctgatggcaagggggtacatggcatgagtatgttcccacatactgtaaccctctataacgtatccaacgaggaactaccgcccacctttgagcctgttttgaccaactatatcaccgtgctgcgcggggtgctgctggacgaaagcaaagcctccaacgtgtccaaaagcggtcttgagggcgccgatgcggtaaacctgtatatccctgcgaatgtggacgctatggacggtgtaacgggcgaaagaaagcggtatgttggcccgatagagttctggaggacagaggataagaccggcttgtggacactctcagtaagccgtaactgcttttttgtgaaaggagaggctatacaccctgactggactgtgcagaccatcgaggccgcctatgacagcgtgtacgacgtgactaaggtggattacaaggactacagcggcgacatgcggcactgggaagtcggggggaactaagatgcttgggttcaacatccgcagcgatggattgtctgatttatcatcccgaatgtcagcggcctctaaaaaggcaggtcacattgtagcgatacaggtaaaaaaagacacctccccttttgtgccagcactgacgggatcgcttgaccagcggacgaaagtaacagggacgaaaataatatatccggggccatatgcccgctatctgtactatggaaagctgatggtagacccggagacagggagtgcatacgcccggaaaggtacaaccaaaacgctcacggataagaaccttgtgtttaatacatccatgcacgcacaagctcaaagccattggtttgaggccagcaaggctcaaaatcttgccaaatggctgagagtggcgggaagggcgatagacagtgatatttaaagatacaaagaaaagtgctgaaaaacctcgtctccttgtggcatttgaggaagtggacaagatttcccgttccatgctggagtgggtgaatacttttccagataagccggtaacaatcatccactatgagtttctaaacgccgatagcggagaagaaaccgggatggccctttccacaatccaagggacttatatcacccggaaatatattctcggcggctatgaggcggagtatcaatttaaacttatctaccgcatcaaaccggggaacagcaacgacaagcggctgcgggccgatgagctgctgaaccgcttcggcgattgggcaaggacgcggcgcccggacttgggtgaaggaatccgtgcgctgcgagtagaaccaaccacacaatcgtccaaattcgccgcctatgaggacggctatgaggactatcaaattttaatgaagctggcctatgaggtcggcgtgtgaaaggattgacaacatcatggctgatttgacttttaataccacgcccggccagaccataggccgtgaaatgctgatcgcctacctgaatacaggagaaagcggatccccaaaatgggctgcaatcggcaagcgtgtggaggatagctccgccgaatacgactggcagactgaaactaaggtggacattttcgggaacacctataccactggtaaaaaacccacgatcacccaaacctttgagccttgcgaacttgacgcggatgacaaggcgcaggagaaaatctggaacctttccataaaagaccagaacgtaaatgctctgatgaatatggatatgctgattgttcatctgtacgcagggacagcgagcaccgcggtgttcgcagagcggtattcttcctgttctgttcttccgtccggtcttggcggccagggcggaggcacagtcggcatgccgctggacatcacttatggcggcactcgcactattggcacagcatccattagcgatggcactgttacattctcgccgggggaatagttccccggcccgataaagcactcgtcggcgccggggaagtcaacaaagcttatgtgggcagaaaggattaaaaaatgagagaacttaatttcgacagcggcattgtggagtatcgcgtaaacggtaaagcaacactcagcttcaaccgctcagaccctaatctgtacaacaggatgcaggaacttaacggcaagttggcggcgattgacagtgatcttaagaaagagaaagatgccgcagaggacggccttgcgctcgtaaaactgttctcggcctatgacaagcggattaaggccgaattatcctttgtgtttggggaacaaaacgattttgacgctatctttgagggacaaaatgttctttcgattgccgggaatgggaaatttcttataacgaattttattgaagctctccagcctatcattgaatccggcgtgaaggagtatgccaaattagaggccgcaaatgctgttgcgcaggcgaagcgcgaacgggccaaccgatgaaatggacgctcccctcaagccttgatgtaggcgggaagccgtgggtaattcatgcggattatcgggatatcctggatatcatcaacaggcttacagacatcaacacagacaggcagatcgctctgtatgtcgcgctggccctcttttacgaggactttgacgtcatgccggaaaactgcttcgaagaagctatcaaacaaatgctgtggtttatctcctgcggggaggatgatgatggaacgccagcgcacaagatgatcgactgggagcaggattatttcatgattgtctcaggtgtgaacaaggcggcgtcatgcgatgtacgcggtttgaaattcctgcattggtggacgtttatttcctatttcagcgagatcggggaggggcagcttgcaacggttgtctccatacgcgagaagcggcgcaagcataagaaactggaaaaatgggagcaggaattttaccgggagaaccgcaaaaaagtggactttaagcagaagtacacaaaggcggaggatgacgcaatctccttatggacaggaaaagccgccccgtcataagggcggccgtcatgaaagattaggcatcttaagtatcggacgaattagcagtttcaatgatttcgcctgtcgtttcgtttacaaatgtcacgcttacattatcaacaggtgtcccgttgaaaatgttatacatccccccgtaaatgtaaaactgcatcacagaaaaagcctcattaaaatctaattcggaactccttgttgtaattgtaaattccgtataatcattgctcgcgtcaatagcgacgacatttggatagtcttctgatccgatcatttcctccaatgatctagagatgttatcggacagttctttcatcatttcgttgtgttgggcctttgtcattacataggtcgccgagccatcctcattcaacgtcgccgatttaaagcctttttcttttacctctgcatcaagcgtttcctgcgttgcttctccaatgtaatccgcaggaatagtaagcgttacatcaaaaagccgctcatcgacagagatatttccggcggcgtccatgtcaagcggatcttgtacggtttgagtgttgttcggtttattttccgttttatctgctgtttgatcgagggctgaacacccgaaaaatagcatggctacagacaaggctatacagtaggctaacaatttacgtttcatgtgagatcctcctattgtcagaatatgaactaattgtaaatgctcccaagctgaaagtcaagccaaaaaggacggtgacatcgtggcaagtgcggacggcagcattattattgacataaccgccgaccccaaaaaggcgcttggcggcttgaaggccatccagaataggctggacggaatggcctccgctgccaaaaaattgactggaattatcgccggtgcgtttgctacccataaaatcgtccagtttggcaaagaagcgattcagcttggcagtgatgttgcggaagtccagaatgtagtggatgttgcctttggcgaaatgtcgtacaaggtggaggaattcgccagctctgccattcaaaactttggcatgcgtaccctggcggcaaaaaagacggcttctacatacatggcgatggctaaaaatatgggcctgtctatggacgcagcctccgatatggccatcacattgacagggctgacaggagacgtcgcctccttttacaatatttcacaggatttggcggatatcaagctgaaatctgttttcacaggggaaaccgagacgctgaaagatctcggaattgtgatgacgcaggccaaccttgaagcgtatgcgctcaatcaggggataacaaggagcataaaaagcatgtcacaagcggagcttgtgactttacgatataactttgtcctcgatcagctcgccatggcctccggggactttgtccggacgcaggatagctgggccaaccagacgcgcatactgtccatgcaatggcaggagttcatgtccattatcggacaggcacttacgcaaatcctcctgcctgtggtaaaggtgctgaacaaagttgtttccagccttatcaccatggcaaacgcctttaaggcggcggtatcgtctatgtttggcggtacgaacaatacacagcttaagcaggagcaggaggccgtcggcggcgtttcgtctgagatcggaagcgccgttgaaaaccaagaggaccttacagatgcgacagctcaaacaaacaaggagcagaaaaaatcacttgccgcttttgatgagatcaaccgtcttgccggggatactgcatctatttcgggctctggcagcggcgccgggattgatacaggtgtcggagggggcacgttcgttgaggttcctgcgccggacaccgagggcgtacagatggcttttgattcctggggcgaggcgctcgacacctttgtaacatacctcattgagcagggcatcccgaaactgaaagcggcgttcactggattcgccacgtggctcaacggtttctccgccaagctgtacgaagcattcaccttccccggcttggctgaaaagtttggcattttgggcgcggagcttgccgacgcgtttaacggccttgtatcggccattgactggtatacgcttggcgcggcactgggtgctggatttaaccttgcgctgcaatttcttgtcaacctgatctatacgtttgactgggttggtttcggcgccagcttggcggcggccgtaaacggcgccgtaagtcagattgactggtatgcggttggacagatgttgtgggctgggttcaagtgggcgctcgaaacgcttgcgggctttctccttggtctggatatggcccagcttggacaagctgcgagtaatatcgcaatcggcttcttcaattccatcaccgaaacgctgcggactatcgactggtcacagatcggtgcgcagatagccgaatttatgaacaacatcgattgggcgggcgttattgcggctatcgctgaaacgctgggggcacttatcccgtcgctgcttgaacttttggggggatttatcgccaatgcggacccatctacgattgttgcatcgattatgattttggttggattaataggcttgcaattacttccgctgataaccgccgcaattggcagttttatcacggggaagatcagccttgccgtcacctcgggacttaacggcctgcttggcgcgatatccccggctattaacagtatcaagcaattactcgcctctattttcagcggcgcttccccgctagctggcgcggcagctctgtttggcggaattgctttggcggcagggaactttttcgacatgcttaataatggattcagttggctgaatgagaccctcatgatcgttggtaccggcctcgcggctatcggcgcgatcattcttggcgcgcctgccgcagttgcgggcgttgtggcgggcattgttgctgcggttgcaacgctcgttgtcctcatcgcgcaacactgggaagaaattaaggccgggtttattgctgtgtgggattctatcaaagcggtttttgcaaccgttgcggagtgggtcaacacgaacgtcatacagccagtcgctgagtttttcacagggctttggaatactattaaaaccctcgcctcagacgcctgggcgggcattcaggagatttggggcgcggtgtccgcatggttcaatgaaaccgttattcagcctgtaggcgagtttttctccggtctatgggatggtatcaggcaaacggcgtccgatgtgtggaacgccattgtggaggtatggcaagctgcgggaagctggttcgaggaacatgttaccggtcctattggaaaggcttttgaagctgttggagacttcgtcaaaggcgtttttaataaaattattggttttatcgagggacttatcaacaaggtgatcgatggcatcaactggctgattgatcagttgaacaaaatcagtttcgaagtaccagactgggtgcccggcattggcggaaagtcctttggattcaacatatcgcatgtttcagaggtaaagctcccccgtctggcgacgggtgccgttgtaccgccgaacagagaattccttgctatgctgggcgataacaagaaagagacagagattgtctctccgctgtccaccatgaaacaggctcttatggaagccttgcaggagagcggcgcggctggcggcggggatgtgacaatcgttgtcaatctggatggccgggaagtggcaagaaatactgtccggcatattaaccagatgacccgttccggcggcagaagcccgctccttgtgtaaggggggattaaattgattgaagttttaaagatcaatgggcacgattattcaaagtttgttgagcaaaagggctatggctggtcccgcaatgatctggatgggggccaatccgggcggacaaaggacggcgttatgcggcgcgtcaaggtagccgcaaagcggaagatatcgtacacgctgtttaatatgacgcgggcagatttggcgaggctcgacgatgatttgagcacggcggaatttaatgcgacttatcttgatatccacggtgttacaacaaggcggttttactgttctacattcagcgcgacttgtgatgtgatcgacggcgacgatgacaagtgggagggcgcgaccttcgacatgacggagatttaaaatatggcgcagaaaacaagcgggctgtggaaacagttattccggcagcgcggaaccatatgcgagtacaagttcgatattaacgggcgcgaatacggaccagagagcgaggtttcccactccgtcagccagagcctgtttgatgatttcagcattggtaacgccatgtctgcaaccctgacgttggagttatacgcgcctgatatcccgcgcggcgccgtcataaagcgttttgtccgtctgcgtaacggtgtaacaagctcagagtggctccccaaaggtgtgtttttcgttaaccgcagagagcagtcagacggcgtttggaagctggaagcatacgacgccatgttaaaggccgatatgacctggacgccaaagacgccagtcgcaacatttttcccctgcacgatggaacaggcggcgcgggacatagcggcatcaatggacgttggtatcgacgagcggactgtatttctcccctacaccatgaacgcttatccagagggggaatatatgcggcgcgatgcgctttgtgacatagcggcagcccatgggggaaactggattatcaacgataagggcgatctccggttgatacctcttatttccgctccggctgacagcaactatcttgtcacggagcacggcgatgcgattgtgtttgggggtgtgaaaatccttgtcagataagcatcaagtaggcttaagtgtgactgattttgtggataatggcatccggcagaaaataacatctgtcacgctccagactgcaaatgatcagacaataacggctggccgatatgatgggatagatttgtatgcactctgcccatacgcaacacaggaaatggcactcgcaatacttgtgcaggtacaggattaccagtatcaggcatttgatgcgaaagcggcggggattgaccctgctgcggaactaggcgatggcgtaaatgtttgcggtatttatggcgttttgtcaagcatcgaagatcatggggacggattcccggatatatccgccccaggcgagcaggagcttgaggacgaatatccgtatcagtcccgtacaaacaggtcgctttccaacgacacggacagcctgcgggcgtttgtaacgcagtcacttggggcgatgcaaattgagctaaacagtatgaaaaccgcattagacaccctgacgttaaaagtaaacgatatatctttagcggttacaaatcttgaaagccgtgtatcggcgctggagggaaagtaaatgccggatagtacaattggcgaactgccccaagttggtagtcttgatgatgattctctgatggtggtggagcagcaaggctcggccatgaaaatgacaggcaggcagttcaaggattttgggcggcagtcggtcattgatgaagtacagggacttgtggacgaggcaaaagctgcggcgaattccattaccaacatgaccgtagaggcacacacagccgaaacccccaccgttgaaaagaccatgaagaacgacgtggttaatctggacttcggacttccgcaagggccgcagggcaaacagggcgagcggggaccgcgcggggaacctgggaagggtctgaccgtgcttgggtactacgcctcggaaacagccctcagagatgcggtgagcggccccagcgtgggcgatgcctacggcgtgggggaagcggcgccgtatgatatctatgtgtttgacggcgtaacgatggactgggtgaacaacggacctttttcgggcggcggtggcggagacctgaccaatgttgtccgttccgagggcggggccgacatgcagtattcagaggcgtttccggatgtccctcacaccatcctggtaacggatgaggaggagccgcccctgaccgccgacgatatagaaatcacgccgccaaaggggatgaccgcaagcaccgtacaggaggcggttgaccagctttttatctctgtcagtaatgggaagaagaaggttgcgtccgccatcactgacaaaggagtagaaacggcgcaggatgcggcattccagacaatggcggacaacattgccaagatacagaccggggcaagcacgggggacgctacagccacggcgggggatatcctcgccgggaaaacggcttacattgccacaggtaaagcggaggggctgatcccaaccaaaagcgcgcggacttacacaccggggacgtccgaccaaacgatcgccgcaggccagtatttaggcgggacacagacgataaaaggcgacgctaacctaacctctgtcaacattaagaaaggcgtatccattttcggtgtgaccggagcaatggagagcaccttccaagccacattgacggtcacggtcgatgtgggcgcggtggtcacagcgacatccgggagccggaaggtggaggccctgtctactaccggcacagtggtcatggatctgcccacagaaggtacatggtccgttacggcggtgcgcggtgcggcgcagtacaacacggtcacagtggtggtgacaaaccaatataaagccgctttgaccgcatcgctgcatgtgcagtattttatagaagctactccattaagcgaagcacggtcgtcgcttgcggccgctgcggtgggcggatacgcattgtttggaggaggccagtcaggtaacaactatgtcagtggcaaatccaacgtggatgcatataacaaggaattaataaggacaacgcccacacccttaagcataggacggtctaagcttgcagcagtcgcagtgggtgaatatacgctgttcggaggtggcgaagcctttagcggtggctatggttccgaatccaatatagtagacgcgtacaacgggagcttgacgaggacgcttccccaagcactagacctagcgcggtctaatcttgcagcaaccgcggtgggcggatacgcattgtttggaggaggttataacggtaccacctatgtctccgccgtagatgcatataatgaaagcttgactcgaacgacgcctacaccgttgctcgtaggccgggttggtgttgcggcagcctctgtaagtgggtatgcattattcgcagggggcgattccgcgggcagcgatgctagcgttgcagtcgtagatgcatacaatggcagcctgacgagaacaactcctctggcattgagccaagcgcggcgcgaaagtgcgggagccgcggcaggaaactacgctatgtttgtaggggggcatatccgtcagacgggaattaaaacaaatgtaattgatgtttatgatagcttcttaacaaaaacatcgtcggttgagatttttgagactgatacattgcttgcgggagcttcgctgaaagggtttgcaatatttaaggagcgagatggtaattcggcggctgtgtatgatccatatctcgtccgcacctttgctcccggcgcaacatctggttcggatacaaccgccaccgctgcggttggagagtatgcgctgtttgggggcggcataatagaccacgtaaaccccgaatcaaataccgtcgatgtttataaatacacatgaggaggcgcgtcatggcaatttatgtagacggaaaaaaggtcgcaggttttggcgcgggcggcggaaaggtcccgattgtaacatctccgccaagcgacgagaagatcactttttggctaaataccgaaacgccggttgaggacatcccggctatagatccgccgggcgccgctgaaaaagctctggaggacgcgaaaaaatatacaaatgaatatgctcctgcaaaaccgcaagccgtacaaggaaatcttttgatagccggagaaaatggaaaacttgaagatagcggtattgcacgggaacaagtatcggcattatttcaatcagagcccttgatattcttaaacggttgggaagacaatggcggctccaaaatagcttttactgaaaacttgataactctatatatacgcgcaagaggaacacaattggaatttaatacagttatcgcaagatcccctcaaattccaattaaacaggtagtttttactggggtagtaagttcgcttgattcactagaaaaaagcccactaatacttgttctggagctaaatggaaatataagggttggcgcatcaggaaggccaaatgaagcttcagatctgtgggttagttcaacagctattcaatgacggggggggggtaagcatggacagtctggagaaagcgttatttcaggtgaagatcccaatccaggaaaaaaataattgctttttaagcgatgaaggttttttatttacgcctttgaaaatcaatggagttgttgtaaaaaccggaaatgaagtgtatcaagaatggctaaatctgaaaaatgaagccatcataggattaaatttgacagacgcctgggaacagataccgggaaacatatctggaatatcgcaaattggaaatttggcgcaaataaatgcaaatataaaaagcaaaagagagatcggcgcagggaaaattattttaaatctcccgattaagccaatttccatgcaatacccaactgtttctgtggatgaagggcaataccggttacagttaagtccggacggcacattaataacaactgaaataatcccgataggcacaagccttcacttggatttttcttatatcagtaaagaggtgtaaaatgcaggataatttgattgcagcgattcaatatcgtgatcctaatacaaaagaaattaaaattcttcctgcgattccgggaaaatcggcgtataaatcggccgttcagggaggatttacaggagacgaagcggattttaatcaaatattagcagatttgatgccaaaaacagaaattgaagaaaaactgaatgcaaaagccgatacggttgatttaaataccctaaaaaatgattattataccggcgctattatatccgaattttcttcacctcgacaatttccgcatgctgggttgtatcatatcttagcaatgacagaggaagttaatcaacatttagacgatcccagttttgcaatgacagattataatgtcggcgattattatgcgcagctgcttacaagttttacagatgcaaacggcggctgcatgtatggaacgttgatcgtcacctctccgcgtttggccaagaaagtatgggtcggccgtgtgtgggaatatgaaataaaagaatgggtgttgctggcccatgcatccgcaccgcaacagtatgatatgacattatatggcggcctcttggggcgtgccaaatattctaaaggccaatttgggatggtttggcttgatataaatgtacatataagcgagacagaagataaaattacacataatttccttgtcagccatctaccggaagggttccgcccgaaagataacacgcttatcccggtttgggtcggtaaaggagaaaaagataacacaaaaatgatgggaaatataatagtttatgctgatggaggtatttggttttacataggagacggccttacagcacgtagctttgcaacacaatgcggattttatatttaaattagaaggggatgagaaaaacggattacaaatactgcagcgtcattgattcgcaaaacagatacaaaactttggtattggtatttaatgcactggacgaaaccggagagacgcaggaaaagattcagtattatacgcttttggaaggggaatgtttggtagacgcgccgccgccaatgatgcggccgtatgccggtgcggatgggtttgtcagaccggcctgggatggctcagagtggagggaatccgccacaagcggggaaatcgagacgtgggagacggagcaccccgcgccgcctcctgtcccgccctccaagaacgaacgtattacagcattagaaacgcagatgaccgatgcgcagatagcactcacggaaaactacgaaacggcagacgggcagaacacagacgccatgcttgcgttggcggaagtatatgaaaccatgatcgccctgcaaacgcgcgtggcatccctggaaggtggtaggaaaacgaatggctaaagtatacgcaacactgatcatgaaaggcaaaaagacgctggatgacgttccggcgctgctcaaagaacaggtacaggaaatccttactgctcttagctttaaaataacagattgaagggagaagtacccatgcgctatcaaatttggaaccgggtagacgacatcatcacgcccagcggggcgaagttcacggcgaaggaatgggcggagaagtacccatggcccaaaatgattatcacagcgggcgttatcaacggcggatgcgccatggagttcaatcaggctgtggagttatacaaaaagtctggtgcgaacattacagaccttatggatgataatgaaattctctcagctatcgaggatttcgaggacaacccgccgcccgcggaacccagtgtggaggagcgtatcgcggcggccttggaataccagaacgccatgatgctgtaaggagggagcgcacatgactttgaaggatatggcaaaaaagaactacgaccggggattatggacagtggaaatgctccaggctctcgttgacaagggcaagctgacacaggaggatatggacaaaatcgtcggaaaataatctgcacaagagaggatatagcctgaatgacattgatggatatggtcgggctgctgaaggacaattatgaggtgcttctgttcctcgcagcggcggcgctgtcggttatacaaatcgcgccgattaaaattaacccgtggtcggcgatggcaaaagctgtccggggcatgcttaatcgggacgtgataaaggagcttgaagatctgcggcatgatgaagccgagtacagaggggaaatccgggaagcgctggatacatacaagagtgtcctggacggcatcatacagaccggtgatgaacggaatgcggatttgcaccgttacaggattttcaggtttaatactgagctgcttcgagacgtaaaacacaccgaggaggagtacaacgaaatcctgcataatatcaaaggatacgaacagtactgtaaaacccatccgttgtacgagaataatcgggcggtgcttgccattgaaaacattgaacgtgcatataaagagcggatggtaaaacgcgatttccttgattaccgggagacaaggtaaaagaggccgtttcgggtggtctggaaatttgagagaggagctatttaatatgacattcgatatcacacctatcatggaagcaggattcactcttattggcgcgctggtgacagcgtttctgattccctatatcaaaagcaagaccaccgatgcacagcgtaaagaaatgcttgagtgggtgaaaatcgccgttgcggccgcagaacagatctacaaagggcaggggcacggcgaggaaaaaaagcagtatgtgatccagtggttgtctgaccacggtatcacagcggactacgataagcttgacatgatgatcgaagccgttgtcaaccagctcaacggcggaaagctgtccgcgggacaagcttaactaaacattttggaggtcgtaaggtgggagaagtcatcaagggtatcgatatctcgtcgcaccagggagaaattgattttgagcgcgtgaaggcggacggcgtccgctttgtgatcatcaaagccgggcagggccttcgggaaatggggacgttccgtcaaaaatacctgcctgctgtactggccgcggggcttgattggggcgcgtactggtggagcgacgccgtgacggtcgccgaagcgcaaaaggaggcggcggcattcgtcagggcgctcgacggcctgcgcccgacctatccggtgtacatggaccaggaatacgaatccccctgcggtaacgcttggggagtaggcaagggaaagcagcttcgtaccgacatggctaaggcgtttctaaaggttctggaggacgccgggtactacgcggggctgtacgcttcgacaaactggctgcaatactgggtggacgacaaacagcttgaagcatatgacaagtgggttgcacagtacgccgaaaaatgcacctacaccggcagttacggaatgtggcagcatcatggggacgcgcggggctttgtagggcgtgtggacggtatttctgtaccggtcgatatcaacgcctgctaccgggattatccggagatcatccgggcaaacctgctcaacggctggaagtgtgaggataagccggacgcgtctgagggcgagatgatctcaattttaaaaccggagttggaaaggctgcgggatgatcttgccgcagcgcttggggccgtgaaacaactgttgggggagctggggcatggagctgcttgaacggtttgttcccttatttgtcgcagtgctgacggcggtaactccaatagtgctgacgattcattcaagcggccgaaaagaccgcgcgcagggaaaggaaaattcagaaaagctgtacgccatacggaatgaaatgcacaaggatgatgtaaagcccgcacagtacgacccggtcatgtactctcgtgccccagcagttgtcgagaaatcctcgatggttgacaggtacagtggctttcttcgggctgtatatggcaaagactcgcgcgcggcgtggaccattatggatgacctgatggacacgctaaacattgttaaccgtaaaatttatgacagtgttatgcgaaaatttgccgcattgtgaacacagggagggcgccactaagcaccctccctaatttcagaaaaatgtgttactaatttgttactaattgtctcgttttcaccccgtttcacacagctttgtatattaaacaatcccgatgaatacgggctttccgggcattgaatgaaggtctaaattatgatacaataagcgcagtggaaacgacagagccgcttgcagccgccattcggcggtaactgctgtaagatggcagactgcgcatgttgcgcaacgaaaaccggctttgccggttttgctgccgctttgcggcagacgattcagtttggacgtgctgctgcggtacaataaacgatagaattcctggcgctgccagcgtcacagtgtggaggaaatgatgggttgtaaagatttggaatctgcgaagcgccgtgtacaggagctgcgcacggtcattgaaaagcataatcacagctattatgtgctcgaccgtccgactgtcagcgattatgaatatgaccggcttctgcacgagctgattgatctggaggaagcgtttccggagcttgcgagcgaccattctccgacacggcgtgtcggcggcgcggcgctcaacacatttgcgcctgtgcgccatgaggtgcagatgggttcccttcaggatgtgtttgatacggccgaactggaggcgttcgacgcgcgcgtgcgcgaacagatcgagcgtccggtttatatcgttgaaccgaagatagacggactttcggtcgcgcttgaatatcaagacggcgtatttttccgcggctccacgcgcggcgacggtgttacaggcgaggacgtgtctgaaaatttgaaaacggtgcgttctatcccgatgacgctgccggaggcgctgccgctgatcgaggtgcgcggggaggtttatatgccgcgctccagctttgaacgcgttgtggcgcgccagcttgaaaatgaggaggagccgtttaaaaatccgcgcaacgcggccgccggctccctgcgtcagaaggacagccgtgtgacggcgcagcgcgggctggatatttttgtcttcaatattcagcgtatcgaggggaaaacgctgtcgggccataaggaatcgctcgattatatgaaaagcctcgggttcaaggtgattccgtcgtacaaggcgtttgacaatatttccgatgcgattgccgaggtggagcgcatcggcgcgcagcggtatgaattcccgtttgatatcgacggcgccgtcattaaggtggatgattttgcacagcgtgaggcgctcggcgcgacttcaaaatttccaaagtgggccgttgccttcaaatatccgccggaggagaagcaatctgtgctgcgcgatatcgaaatcaaggtggggcgcacgggcgcattgactccgactgctgtttttgagccgattacgctggccggcacgaccgtcagccgcgctgtgctgcacaaccaggatttcatcaatgaaaaggggatcgcgatcggcgatacgattgttgtgcgcaaggcgggagacatcatcccggaggtcgtctccgtggcaaggcaccagccagacgcgcccgtctatcaaatcccggctgtatgcccgtcctgcgggagcacggcggaacgcgaggagggcgaagctgtgctgcggtgcgtcaatatggcgtgccccgcccaggtcgcgcgcaatctgacgcattttgccagccgcgatgcgatggacatcgacggtatgggtcccgcaatcgtgcatcagcttttggcggcgggtctggtgaagtcggccgccgatctatacagtctgacgcaggcgcagcttgccgccctggagcgcatgggggagcgcagcgcgcaaaatctgatcgcggcgcttgagcagtcaaagtcgcgcgatttggcccgactgctgtacgcgctcggaatccgtgggatcggccagcgttccgcgcagcttttggcgcagaggttcggcacgatggacggcgtgctcgctgcatccgtggaggagatcgcgcagatcgacggctttggaggcatcatggcgcagaatacggctgattttttcgcgctggagccaaaccgcgccctgatcgaccggctgcgggcggcgggacttaatatggcctgcacaagtgcgccgacagcggacacgctctccggaaagatctttgtactgaccggaacgctcccgacgctgacacgcggcgaggcaaaggcgatgatcgaggcggccggcggcaaagtaagcggcagcgtctctaaaaagacggactatgttgtcgccggcgaggaggccggcagcaaattgcgcaaggccggggagcttggcgtcgcagtactggatgaagccgctctgcgcgccatgctggaggcatagagtggccggttcggatcgggtgatcctgcatgtcgatatgaacgcattttacgcgtcggtggaggcgctgtaccatcctgagacggccggaaaaccgatggccgtctgcggcgatgcagaaagcagacgcgggattatcctcgctaaaaacgagctggccaagcagcgcggcgtcaaaacggccgaaccgatctggcaggcgcgtcgcaagtgtcctgatttgctgctgctgcccccgcaccacgatctgtaccgtgcatattcaaaaaaggcgaatgccatctatgagcggtatactgatcttgtggaggcagcgagcgtcgacgagagttatctcgacgtaacgggcagccggaacctgtttggagacggtgttcagattgccgacgcaatccgcgcggcagtcaaggcggagcttgggttaaccgtttcggtcggagtttcgttttgcaaggtgtttgctaagatgggcagcgactataaaaagccggatgcgacaaccgctgtcacacgtgacaattaccgggatatcctgtatccgctgccggtgcgggatctgctgcatgtgggcggggcgacggccgccgctctttcagggcttggcgttaagaccatcggcgatctggccgcgcttgatgaacagacgcttaaagcgcgctttggtaagcacggccttgtgctttatacgtatgcgcacggacttgacagcgacccggtcaaggcggcaggggagcaggatgaaatcaaatcggtcggcaattcgctgacttataagcgcgacctgcgcaccctggaggatatccgcatcggactgatgccgcttgcggagtcggtcgcgtcgcgtctgcgcgcgcacgggctgcggtgccggggcgtgcaggtcgcaatcaaggacccgtccctgaaaacgattgaccggcaaatgcagctgccatatgcgacgcatcttgcaaaggatctgttcgatgcgtcgatggagcttgtcagccgttcatgggaggtagggcgcccgatccgcctgttgtcggttacggcgatcaacctgacggatgcgggagccgaggagcagttgagcctgtttgaagcgccgcgcgacaccggcaggcaggaggcgcttgagtcgtcgctcgactccattcgggaacgattcggcaagagcgcagtgacgccggccgtgcttttaaaaaatgaccttgggatcaagacataagcagacaagagggaacgatggtttattttaccgcgggtgcgcgataacgcactttattttgtttcactacccagctaattataatgagctgcagcggttcaaccggattttgcggtataatgccggtgtggacgcgaacaatatggcgccggtcagtgcaggagaggtcgcagctttcttcagcggcttgacagcattggcagatggacgccgatagataaagtcggaaggcgttcgcaaactgctttgcagcttgcgaacgcttttgcatatccgccgccttgacatagcgtcatatccgatcatccgtatgcataaaaataaagggaaaccaaattgacggggaggtacaacgcgatggtcgaggaaaaaaagaaagcaggaccgcacaacgtcgtgatggaggaccgtaagcgtctgacagtgacaggtgtgacagagatcgacagcttcgatgagcagacggtggtgttgttttgcgacaccggggagcttgcgatccggggagaaggacttcatatcaatcgaatcgatgtggacgcaggagaattgaacctggaaggcgtgcggatcgatgcgctttcctacgcggataatatgccgtcgcgcggcggcatatggggcaagctgttccgttgaatatctacaaaacgcagggcggggggattgcatggagatcacggtcgcggggcagacctggatatttttgatgtccgttgccctgggcgcagcgcttggcgttttatacgacgtattccggatcgtgcgtatcgcggtgcgcacgccgcccgctgtcgtgcttgtggaggatcttgcattttccattgtttgtacaaccgcgacgtttctgtttttgattggcgcggataaagggcagctccgcatgtttttgctgattggggaggcaagcggtttcgcgttatattactgcacggtcggtaccttgatcataggcgcagcgcgaggaattatcgctgtggtaaaaaggatatgtacgtttttttggaagctgctggtgtctccaattctgcgctttttggaaaagtttggattactaacaggaaaaattgcaaaacaattggcaaactgtctaaaacatcccgcagaaaattcgaatttgcccttgaaaaagcacagtgggatattgtataatttaagaaatcgactgcatagatgtggacagagaaaaaagaaggaaaagcaggagcataccggttcatgaaaaagatacatacaagaaaaaagagcttaatgatccggctgtgtgtgctcgccttttcagcctatgtggtcgtcagtttggtgtcgcttcaaatggagatcgccgaccggcgcagcactttggcgtccataacggagcaggcagagacacagcgtttggccaacaaggagatcgagcggcagatcgcccttggcgacgacaaggattacctcgcgcggatcgcgcgtgaaaagctggatatgggacgtgcggacgagcgtgtgttccgcgacgcggcaggcacctgatgcggctgtgcctgaaaaagggcggcgcgtgtaaaaatctgtttgggtgggctgttttgcagccttgtataaaacacaagacttttaaggaggcagcgtaaaatttatgcagcttgaggttggcagcattcttgagggcagggtgaccggaatcacaaagttcggcgcattcatcgaactgcctggcggcaaaaccggaatggtacatatttcggaggttgcgtcgtcgtacgtgaaggagattaccgattacctgtccatgaaccagatggtcaaggtaaagatcatcgggattacgccggaaggaaaggtcagtctgtcgataaagcaggcggcgccggcatcgccgacccaggacaggcagcccgcgccccgcgctttgcgcggacagggcggcgaccgccctgcgcggccgttccagcgcagagcgccgcgcgaagtttcctacggttttgaccggcgtcagccgatcacaaatgaaaacatgtcgtttgaggacatgatgagcaaattcaaacaggccagcgatgataagatgtcggatttgaaacgctatacggacatgaagcgcggttccgcgcgcaatcgtccgcgctgagaagcgcgtttcgcgcgcggccagtctgtaaaaaagggcgctttgcgccctttttttgcagctttgagaacctgacgcggcaggccgcagaggattgcttaagtgaatgggacggacgtggaagtgatgggcggcttttgccccaatggaaaggaacatttatgctgatcatcaatgcaaatatccaaacaatgacggggaacgattataaaaacggatatatcctgatggaacaaggtaaaattacggctgtcggcgatatggcgcaggctccaaaggcggattgcctttacgatgcgcacggcgcgtttgcgcttccaggctttatagatgcgcactgccatatcggtatgtgggaggatggtcttggctttgaaggggatgacggcaatgaggataccgatccgtcgacgccgcatctgcgtgggattgacggcgtaaatccatttgaccgcgcattttccgaggcgctcgattatggcgtaacgacggttgtaaccggaccaggcagcgcaaatcctatcgccggacaaatgtgcgcgcttaaaacgtatgggcgccgtgtcgatgatatgatcgtgcgtgcgccgcttgcaattaaaatggcgcttggagagaacccaaagacaagctaccatgaaaagcagcagggacccgcgacacgcatggggatcgcggcggtgattcgggagcagcttgcaaaggcgcggcgctatgcgcaggaaatggacgaggccgcgcaggatgatgagatagacgaaccggaatttgacgcgaaatgcgaggcgctgctccctttgcttgatgggcggatcaaggcgcatatccacgcgcaccgtgccgacgatatctttaccggcatccgtattgcaaaagagttcggctttggatatgtgattgtgcatggtacagaggcccatttggtcgccgatctgcttgcgggcgaagatgcgtcagtgatcgcgggaccgctgcttggcgcacgcacaaagccagagcttgcaaattcgagcgccgctgggatcgccgcgatttcacgcgcgggcgtgcgggttgccgtcgcgaccgatcatccagagctgccgtgccattgtctgttgttaagcgcccaactggcggctgacagcggattggagcctgcaaaggcgctgcgggcaatcacggccgacgcggcggaaatctgtgcaattggcgaccgcgtcggttcaatcgcgcctgggtatgacgcggacatcgtattgtttgatgaggaaccaattaagacacgtaaaaagccgcaggcggtctttatcgacggggagaaggtgcgcggatgagagagcttgcatatgaagcagtggtcgaggctgtgtgcgatctctgcattgaggcaaatcggatactgccaagcgatcttaagacacgcttgcagcatgcctgtgacgaggaggaatcaccgcttggacgccaggtgctcggtgacttggtgcgcaattatgagatggccgagcagatgtgcctgccaatttgtcaggataccgggatggccgttgtgttcgcggacattggcgaggatgtgcatgtgcaggggttgacagaggccgtcaatgagggcgtgcggcgcagctatttggaaggattgctgcgctgttctattgtcggagatccgctgcgccgcatcaacacaggcgacaatacgcccgcgatgctgcatttacgcattgtgccgggcgaccgcctgtcgctcacagtcgccccaaagggcgccggaagtgaaaatatgagcgccatccgtatgatgacgccggcggccggcgaggaagatctggtacgcgttgtgactgagattgctgtgcaggcgggaagcaacccttgtccgccgcttgtgataggcgttggaatcggaggtaattttgaagggtgcgcattgctggcaaagcgggcgctttgccgtgacacatcactgcgcaatcccgatccgctttatgcacagcttgaggcgcgaatgctcgaggcggtcaatcgcactggtatcggaccacaggggtttggcggccgtgtgacagctctggcggtcaacattgaaacgggaccgacgcatattgcaagtctgccggttgcggtcaatatgggatgccatgtcacacggcatgcgcagcgtgtattgtaatgctccatgtacaagacatggatgatctgtaaatttttaaaagagcattgtaatttcgaccaacgcattgtataatataggcagaaagattagacaaattgttaaaaacagggtggcctgtttttgatataaaacaaaggggttgaatttatgaacattaccatcacagcacgtaagacctcagtccgcgactcttttaaagatcgcatcgacaaaaagcttgcgaagctcgatcggttctttgatgaaagtgccaacgcgatcgtcactgtaaccaacga
